(12) United States Patent
Bridon et al.

(10) Patent No.: US 7,737,251 B2
(45) Date of Patent: *Jun. 15, 2010

(54) LONG LASTING GLUCAGON-LIKE PEPTIDE 2 (GLP-2) FOR THE TREATMENT OF GASTROINTESTINAL DISEASES AND DISORDERS

(75) Inventors: Dominique P. Bridon, San Francisco, CA (US); Nissab Boudjellab, Columbus, OH (US); Roger Leger, Saint-Lambert (CA); Martin Robitaille, Granby (CA); Karen Thibaudeau, Montreal (CA); Julie Carette, Ste-Catherine (CA)

(73) Assignee: ConjuChem Biotechnologies Inc., Montreal (CA)

( * ) Notice: Subject to any disclaimer, the term of this patent is extended or adjusted under 35 U.S.C. 154(b) by 265 days.

This patent is subject to a terminal disclaimer.

(21) Appl. No.: 11/318,323

(22) Filed: Dec. 23, 2005

(65) Prior Publication Data

US 2006/0217304 A1  Sep. 28, 2006

Related U.S. Application Data

(63) Continuation of application No. 10/203,808, filed as application No. PCT/CA02/00175 on Feb. 15, 2002, now Pat. No. 7,112,567.

(60) Provisional application No. 60/269,276, filed on Feb. 16, 2001.

(51) Int. Cl.
A61K 38/26 (2006.01)
A61K 28/28 (2006.01)
A61K 38/00 (2006.01)
A61K 61/00 (2006.01)

(52) U.S. Cl. ............... 530/308; 530/300; 514/12; 424/1.69

(58) Field of Classification Search ............ 514/12
See application file for complete search history.

(56) References Cited

U.S. PATENT DOCUMENTS

| | | |
|---|---|---|
| 4,462,941 A | 7/1984 | Lee et al. |
| 5,424,286 A | 6/1995 | Eng |
| 5,493,007 A | 2/1996 | Burnier et al. |
| 5,580,853 A | 12/1996 | Sytkowski |
| 5,612,034 A | 3/1997 | Pouletty et al. |
| 5,654,276 A | 8/1997 | Barrett et al. |
| 5,789,379 A * | 8/1998 | Drucker et al. ............ 514/12 |
| 5,834,428 A * | 11/1998 | Drucker ..................... 514/12 |
| 5,840,733 A | 11/1998 | Krantz et al. |
| 5,843,440 A | 12/1998 | Pouletty et al. |
| 5,942,620 A | 8/1999 | Krantz et al. |
| 5,952,301 A | 9/1999 | Drucker |
| 5,990,077 A | 11/1999 | Drucker |
| 5,994,500 A | 11/1999 | Drucker et al. |
| 6,051,557 A | 4/2000 | Drucker |
| 6,087,375 A | 7/2000 | Bridon et al. |
| 6,103,233 A | 8/2000 | Pouletty et al. |
| 6,107,489 A | 8/2000 | Krantz et al. |
| 6,184,201 B1 | 2/2001 | Drucker et al. |
| 6,277,583 B1 | 8/2001 | Krantz et al. |
| 6,277,863 B1 | 8/2001 | Krantz et al. |
| 6,284,725 B1 | 9/2001 | Coolidge et al. |
| 6,329,336 B1 | 12/2001 | Bridon et al. |
| 6,403,324 B1 | 6/2002 | Krantz et al. |
| 6,437,092 B1 | 8/2002 | Ezrin et al. |
| 6,440,417 B1 | 8/2002 | Thibaudeau et al. |
| 6,451,974 B1 | 9/2002 | Hansen |
| 6,500,918 B2 | 12/2002 | Ezrin et al. |
| 6,514,500 B1 | 2/2003 | Bridon et al. |
| 6,593,295 B2 | 7/2003 | Bridon et al. |
| 6,602,981 B2 | 8/2003 | Ezrin et al. |
| 6,610,825 B2 | 8/2003 | Ezrin et al. |
| 6,706,892 B1 | 3/2004 | Ezrin et al. |
| 6,723,530 B1 | 4/2004 | Drucker |
| 6,767,887 B1 | 7/2004 | Hoffmann et al. |
| 6,821,949 B2 | 11/2004 | Bridon et al. |
| 6,849,714 B1 | 2/2005 | Bridon et al. |
| 6,887,470 B1 | 5/2005 | Bridon et al. |
| 6,887,849 B2 | 5/2005 | Bridon et al. |
| 7,090,851 B1 | 8/2006 | Bridon et al. |
| 7,112,567 B2 | 9/2006 | Bridon et al. |

(Continued)

FOREIGN PATENT DOCUMENTS

| | | |
|---|---|---|
| DE | 41 22 210 | 1/1993 |
| EP | 0602290 | 6/1994 |
| WO | WO-91/08220 | 6/1991 |
| WO | WO-93/25217 | 12/1993 |
| WO | WO-95/10302 | 4/1995 |
| WO | WO-96/06626 | 3/1996 |
| WO | WO 97/25074 | 1/1997 |
| WO | WO 97/29372 | 1/1997 |
| WO | WO 97/46584 | 12/1997 |
| WO | WO 98/00171 | 1/1998 |

(Continued)

OTHER PUBLICATIONS

Tavares et al., 2000, "Enzymatic- and renal-dependent catabolism of the intestinotropic hormone glucagon- like peptide-2 in rats," American Journal of Physiology, Endocrinology and Metabolism, 278(1), pp. E134-E139.

(Continued)

*Primary Examiner*—Cecilia Tsang
*Assistant Examiner*—Maury Audet
(74) *Attorney, Agent, or Firm*—Jones Day

(57) ABSTRACT

This invention relates to glucagon-like peptide 2 (GLP-2) derivatives. In particular, this invention relates to GLP-2 peptide derivatives having an extended in vivo half-life, for the treatment or prevention of gastrointestinal disorders or diseases such as inflammatory bowel disease and other gastrointestinal functions, from any segment of the gastrointestinal tract, from the oesophagus to the anus.

52 Claims, 3 Drawing Sheets

U.S. PATENT DOCUMENTS

| | | |
|---|---|---|
| 7,144,854 B1 | 12/2006 | Bridon et al. |
| 7,166,695 B2 | 1/2007 | Krantz et al. |
| 7,226,990 B2 | 6/2007 | Knudsen et al. |
| 7,256,253 B2 | 8/2007 | Bridon et al. |
| 7,268,113 B2 | 9/2007 | Bridon et al. |
| 7,307,148 B2 | 12/2007 | Bousquet Gagnon et al. |
| 2001/0047084 A1 | 11/2001 | Knudsen et al. |
| 2003/0170250 A1 | 9/2003 | Ezrin et al. |
| 2004/0127398 A1 | 7/2004 | Bridon et al. |
| 2004/0138100 A1 | 7/2004 | Bridon et al. |
| 2004/0156859 A1 | 8/2004 | Ezrin et al. |
| 2004/0266673 A1 | 12/2004 | Bakis et al. |
| 2005/0065075 A1 | 3/2005 | Erickson et al. |
| 2005/0070475 A1 | 3/2005 | Bridon et al. |
| 2005/0176641 A1 | 8/2005 | Bakis et al. |
| 2005/0176643 A1 | 8/2005 | Bridon et al. |
| 2006/0058235 A1 | 3/2006 | Bridon et al. |
| 2006/0135426 A1 | 6/2006 | Bridon et al. |
| 2006/0135428 A1 | 6/2006 | Bridon et al. |
| 2006/0241019 A1 | 10/2006 | Bridon et al. |
| 2007/0207958 A1 | 9/2007 | Bridon et al. |
| 2007/0269863 A1 | 11/2007 | Bridon et al. |

FOREIGN PATENT DOCUMENTS

| | | |
|---|---|---|
| WO | WO 98/05351 | 2/1998 |
| WO | WO-98/08872 | 2/1998 |
| WO | WO 98/11437 | 3/1998 |
| WO | WO 98/24813 * | 6/1998 |
| WO | WO-98/24813 | 6/1998 |
| WO | WO 99/07404 | 2/1999 |
| WO | WO 99/24071 | 5/1999 |
| WO | WO-99/24075 | 5/1999 |
| WO | WO 99/24076 | 5/1999 |
| WO | WO-99/24462 | 5/1999 |
| WO | WO 99/25727 | 5/1999 |
| WO | WO 99/25728 | 5/1999 |
| WO | WO 99/43361 | 9/1999 |
| WO | WO 99/46283 | 9/1999 |
| WO | WO-99/48536 | 9/1999 |
| WO | WO 00/69902 | 5/2000 |
| WO | WO 00/70665 | 9/2000 |
| WO | WO-00/69900 | 11/2000 |
| WO | WO-00/69911 | 11/2000 |
| WO | WO-00/76550 | 12/2000 |
| WO | WO-0076551 | 12/2000 |
| WO | WO 01/17568 | 3/2001 |
| WO | WO 01/17614 | 3/2001 |
| WO | WO-01/68142 | 9/2001 |
| WO | WO 02/62844 | 1/2002 |
| WO | WO 02/66511 | 2/2002 |
| WO | WO 02/96935 | 5/2002 |
| WO | WO 2004/011498 | 2/2004 |
| WO | WO 2005/012346 | 2/2005 |
| WO | WO 2005/103087 | 4/2005 |
| WO | WO 2005/108418 | 6/2005 |
| WO | WO 2007/053946 | 5/2007 |
| WO | WO 2007/071068 | 6/2007 |

OTHER PUBLICATIONS

Akii et al., 1984, "Endogenous opioids: biology and function," Ann. Rev. Neurosci., vol. 7, pp. 223-255.

Stehle et al., 1997, "The loading rate determines tumor targeting properties of methotrexate-albumin conjugates in rats," Anti-cancer Drugs, vol. 8, pp. 677-685.

DaCambra et al., 2000, "Structural determinants for activity of glucagon-like peptide-2," Biochemistry, vol. 39(30), pp. 8888-8894.

Oren and Shai, 1998, "Mode of action of linear amphipathic alpha-helical antimicrobial peptides," Biopolymers (Peptide Science), vol. 47, pp. 451-463.

Patrias et al., 1994/1995,"Trimethylaminuria (Fish-malador syndrome) fnad the flavin monooxygenases", Biotech Report, pp. 106-107.

Hirai et al., 1979, "A new mast cell degranulating peptide "mastoparan" in the venom of *Vespula lewisii*," Chem. Pharm. Bull., vol. 27(8), pp. 1942-1944.

Reubic et al., 1982, "Specific high affinity binding sites for somatostatin-28 on pancreatic beta-cells: differences with brain somatostatin receptors," Endocrinology, vol. 110(3), pp. 1049-1051.

Drucker, 2001, "Minireview: the glucagon-like peptides," Endocrinology, vol. 142(2), pp. 521-527.

Thim et al., 1998, "Cart, a new anorectic peptide," Int. J. Biochem. Cell. Biol., vol. 20, pp. 1281-1284.

Kapas et al., 1995, "Cloning and expression of cDNA endocing a rat adrenomedullin receptor," J. Biol. Chem., vol. 270(43), pp. 25344-25347.

Smith et al., 1989, "Atrial natriuretic factor during fetal and postnatal life: a review," J. Dev. Physiol., vol. 12, pp. 55-62.

Drucker et al., 1997, "Regulation of the biological activity of glucagon-like peptide 2 in vivo by dipeptidyl peptidase IV," Nature Biotechnology, Nature Publishing, vol. 15(7), pp. 673-677.

Drucker et al., 1996, "Induction of intestinal epithelial proliferation by glucagon-like peptide 2," Proc. Natl. Acad. Sci., vol. 93(15), pp. 7911-7916.

Proceedings of the 8$^{th}$ American Peptide Symposium, 1983, 409-412.

Mumby et al., 1986, "Antisera of designed specificity for subunits of guanine nucleotide-binding regulatory proteins," Proc. Natl., Acad. Sci., vol. 83, pp. 265-269.

Lovshin and Drucker, 2000, "New frontiers in the biology of GLP-2," Regulatory Peptides, vol. 90(1-3), 27-32.

Selkoe, 1993, "Physiological production of the beta-amyloid protein and the mechanism of Alzheimer's disease," Tins, vol. 16, pp. 403-409.

Baksheeva and Fuller, 2000, "Humoral factors in intestinal adaptation," Trends in Endocrinology and Metabolism, 2000, 11(10), 401-405.

Davis et al., 1991, "Reductionof Immunogenicity and extension of circulating half-life of peptides and proteins," Peptide and Protein Drug Delivery, Marcel Dekker, Inc., NY, NY, 831-864.

Paige et al., 1995, "Prolonged circulation of recombinant human granulocyte-colony stimulating factor by covalent linkage to albumin through a heterobifunctional polyethylene glycol," Pharm. Reserch., vol. 12(12), 1883-1888.

Poznansky, 1983, "Enzyme-protein conjugates: new possibilities for enzyme therapy," Pharm. Ther., vol. 21, pp. 53-76.

Poznansky et al., 1988 "Growth hormone-albumin conjugates reduced renal toxicity and altered plasma clearance," Federation of european Biochemical Societies, vol. 239(1), pp. 18-22.

U.S. Appl. No. 60/037,412, filed Feb. 5, 1997, Drucker.
U.S. Appl. No. 60/103,498, filed Oct. 8, 1998, Coolidge et al.
U.S. Appl. No. 60/132,018, filed Apr. 30, 1999, Prickett et al.
U.S. Appl. No. 60/152,681, filed Sep. 7, 1999, Ezrin et al.
U.S. Appl. No. 09/424,571, filed Nov. 22, 1999, Erzin et al.

Alberts et al., 1994, *Molecular Biology of the Cell, Third Edition*, New York: Garland Publishing, p. G19.

Barragán et al., 1996, "Interactions of Exendin(9-39) with the Effects of Glucagon-Like Peptide-I-(7-36) Amide and of Exendin-4 on Arterial Blood Pressure and Heart Rate in Rats," 67:63-68.

Binder et al., 1984, "Insulin Pharmacokinetics," *Diabetes Care* 7:188-199.

Breton et al., 1995, "Prolonged Half-Life in the Circulation of a Chemical Conjugate Between a Pro-Urokinase Derivative and Human Serum Albumin," *Eur. J. Biochem.* 231:563-569.

*Catalog, Shearwater Polymers, Inc., Functionalized Biocompatible Polymers for Research, Polyethylene Glycol Derivatives*, 1993.

Cooper, 1997, *The Cell A Molecular Approach*, ASM Press (Washington, DC), Sinauer Associates, Inc. (Sunderland, MA), 296-298, 648.

Drucker, 1998 (February), "Perspectives in Diabetes:Glucagon-Like Peptides," *Diabetes* 47:159-169.

Edwards et al, 1998 (December), "Glucagon-Like Peptide I Has a Physiological Role in the Control of Postprandial Glucose in Humans," *Diabetes* 48: 86-93.

Eng et al., 1990, "Purification and Structure of Exendin-3, a New Pancreatic Secretagogue Isolated from *Heloderma horridum*Venom," *J. Biol. Chem.* 265:20259-20262.

Eng et al., 1992, "Isolation and Characterization of Exendin-4, an Exendin-3 Analogue, from *Heloderma suspectum* Venom," *J. Biol. Chem.* 267:7402-7405.

Gennaro, ed., 1995, *Remington: The Science and Practice of Pharmacy*. 19th Edition, 898, 931-94.

Göke et al., 1989, "Characterization of the Receptor for Glucagon-like-peptide-1(7-36)amide on Plasma Membranes from Rat Insulinoma-derived Cells by Covalent Cross-Linking," *J. Mol. Endocrinol.* 2:93-98.

Göke et al., 1992, "Solubilization of Active GLP-I (7-36)amide Receptors From RINm5F Plasma Membranes," *FEBS Lett.* 300:232-236.

Göke et al., 1993, "Exendin-4 is a High Potency Agonist and Truncated Exendin-(9-39)-amide an Antagonist at the Glucagon-like Peptide 1-(7-36)-amide Receptor of Insulin-secreting β-Cells," *J. Biol. Chem.* 268(26):19650-19655.

Göke et al., 1995, "Distribution of GLP-1 Binding Sites in the Rat Brain: Evidence that Exendin-4 is a Ligand of Brain GLP-1 Binding Sites," *Eur. J. Neurosci.* 7:2294-2300.

Gombotz and Pettit, 1995, "Biodegradable Polymers for Protein and Peptide Drug Delivery," *Bioconjugate Chem.* 6:332-351.

Grand, 1989, "Acylation of Viral and Eukaryotic Proteins," *Biochem J.* 258:625-638.

Grieg et al., Jan. 1999, "Once Daily Injection of Exendin-4 to Diabetic Mice Achieves Long-Term Beneficial Effects of Blood Glucose Concentrations," *Diabetologia* 42:45-50.

Harlow & Lane, 1988, *Antibodies: A Laboratory Manual*, pp. 101, 129.

Hoshino et al., 1984, "Primary Structure of Helodermin, a VIP-Secretin-Like Peptide Isolated from Gila Monster Venom," *FEBS Lett.* 178:233-239.

Isoai et al., 1993, "A Potent Anti-Metastatic Activity of Tumor Invasion-Inhibiting Factor-2 and Albumin Conjugate," *Biochem. Biophys. Res. Comm.* 192:7-14.

Lewis, 1997, *Hawley's Condensed Chemical Dictionary, 13th Edition*, John Wiley & Sons, Inc. (New York), 487, 815.

Mattson et al., 1993, "A Practical Approach to Crosslinking," *Mol. Biol. Reports* 17:167-183.

Petrella et al., May 1999, "Development and Validation of an Immunoradiometric Assay (IRMA) for the Quantitation of Exendin-4 in Plasma and Its Application to Preclinical Toxicity and Phase I Clinical Evaluations," Diabetes 48:A425.

Poznansky & Juliano, 1984, "Biological Approaches to the Controlled Delivery of Drugs: A Critical Review," *Pharmacological Reviews* 36:277-335.

Raufman. 1996, "Bioactive Peptides from Lizard Venoms," *Regulatory Peptides* 61:1-18.

Richter et al., 1991, "Characterization of Glucagon-Like Peptide-1(7-36)amide Receptors of Rat Lung Membranes by Covalent Cross-Linking," *FEBS Lett.* 280:247-250.

Robberecht et al., 1985, "Immunoreactive Helodermin-like Peptides in Rat: A New Class of Mammalian Neuropeptides Related to Secretin and VIP" *Biochem Biophys. Res. Comm.* 130:333-342.

Schirra et al., 1998, "Exendin(9-39)amide is an Antagonist of Glucagon-Like Peptide-1(7-36)amide in Humans," *J. Clin. Invest.* 101:1421-1430.

Schmidtler et al., 1994, "Rat Parietal Cell Receptors for GLP-1-(7-36) Amide: Northern Blot, Cross-Linking, and Radioligand Binding," Am. J. Physiol. 267:G423-432.

Syed et al., 1997, "Potent Antithrombin Activity and Delayed Clearance From the Circulation Characterize Recombinant Hirudin Genetically Fused to Albumin," *Blood* 89:3243-3252.

Vandermeers et al., 1984, "Purification of a Novel Pancreatic Secretory Factor (PSF) and a Novel Peptide with VIP- and Secretin-like Properties (Helodermin) from Gila Monster Venom," *FEBS Lett.* 166:273-276.

Vandermeers et al., 1987, "Chemical, Immunological and Biological Properties of Peptides Like Vasoactive-Intestinal-Peptide and Peptide-Histidine-lsoleucinamide Extracted from the Venom of Two Lizards (*Heloderma horridum* and *Heloderma suspectum*)," *Eur. J. Biochem.* 164:321-327.

Yeh at al., 1992, "Design of Yeast-Secreted Albumin derivatives for Human Therapy: Biological and Antiviral Properties of a Serum Albumin-CD4 Genetic Conjugate," *Proc. Natl. Acad. Sci. USA* 89:1904-1908.

Meloun et al., 1975, "Complete Amino Acid Sequence of Human Serum Albumin," *FEBS Letters* 58, 134-137.

Sottrup-Jensen et al., 1984, "Primary Structure of Human α2-Macroglobulin," *J. Biol. Chem.* 254, 8318-8327.

Alavi et al., 2000, "Treatment of inflammatory bowel disease in a rodent model with the intestinal growth factor glucagon-like peptide 2," J. Pedatr. Surg., vol. 35, pp. 847-851.

Boushey et al., 1999, "Glucagon-like peptide 2 decreases mortality and reduces the severity of indomethacin- induced murine enteritis," Am. J. Physiol., vol. 277. pp. E937-E947.

Chance et al., 1997, "Prevention of parenteral nutrition-induced gut hypoplasia by coinfusion of glucagon-like peptide 2," Am. J. Physiol., vol. 273, pp. G559-G563.

Drucker et al., 1999, "Human [Gly$^s$]GLP-2 reduces the severity of colonic injury in a murine model of experimental colitis," Am. J. Physiol., vol. 276, pp. G79-G91.

Jeppeson et al., 2000, "Elevated plasma glucagon-like peptide 1 and 2 concentrations in ileum resected short bowel patients with a preserved colon," Gut, vol. 47, pp. 370-376.

Scott et al., 1998, "GLP-2 augments the adaptive response to massive intestinal resection in rat," Am. J. Physiol., vol. 275, pp. G911-6921.

Tavakkolizadeh et al., 2000, "Glucagon-like Peptide 2: a new treatment for chemotherapy-induced enteritis," J. Surg. Res., vol. 91, pp. 77-82.

Xiao et al., 2000, "Circulating levels of glucagon-like peptide-2 in human subjects with inflammatory bowel disease," Am. J. Physiol. Regulatory Integrative Comp. Physiol., vol. 278, R1057-R1063.

* cited by examiner

Statistical significance vs. control was assessed by T-test: *p < 0.05, p < 0.01, *p < 0.001.

Statistical significance vs. control was assessed by ANOVA: *$p < 0.05$, $p < 0.01$, *$p < 0.001$.

Pre-Dose: plasma sample collected before Example 8 injection; 5' post-i.v.: plasma sample collected 5 min post-intravenous injection of 500 nmol/kg of Example 8.

LONG LASTING GLUCAGON-LIKE PEPTIDE 2 (GLP-2) FOR THE TREATMENT OF GASTROINTESTINAL DISEASES AND DISORDERS

RELATED APPLICATIONS

This application is a continuation of U.S. application Ser. No. 10/203,808, filed on Aug. 12, 2002, which is a National Stage of PCT /CA02/00175 filed on Feb. 15, 2002, which claims the benefit under 35 U.S.C. 119(e) of U.S. Provisional Application No. 60/269,276, filed on Feb. 16, 2001. The contents of all the above cited patents and patent applications are hereby incorporated by reference in their entirety.

FIELD OF THE INVENTION

This invention relates to glucagon-like peptide 2 (GLP-2) derivatives. In particular, this invention relates to GLP-2 peptide derivatives having an extended in vivo half-life, for the treatment or prevention of gastrointestinal disorders or diseases such as inflammatory bowel disease and other gastrointestinal functions, from any segment of the gastrointestinal tract, from the oesophagus to the anus.

The Sequence Listing for this application, incorporated herewith by reference, has been submitted on two duplicate compact discs, under the file name SEQLIST500862002501. This file was created on May 10, 2006, and its size is 479 KB.

BACKGROUND OF THE INVENTION

GLP-2 is a 33 amino acid peptide expressed in a tissue-specific manner from the pleiotropic proglucagon gene, and thus part of the glucagon super-family of peptide hormones. Alternative post-translational processing of proglucagon occurs in pancreas, intestine and brain. Enzymatic cleavages in proglucagon produce numerous multifunctional peptide hormones involved in nutrient metabolism. The major bioactive hormones derived from proglucagon are in the pancreatic α-cells, and GLP-1 and GLP-2 in the intestinal L-cells and brain. It was first discovered to possess potent intestinotropic properties by Drucker et al. (see *Proc. Natl. Acad. Sci.*, 1996, 93, (115), 7911-7916). GLP-2, as a natural intestinal-derived peptide, has been demonstrated to have a significant reparative activity for the mucosal epithelium of the small and large intestine. It has also been demonstrated to increase the ability of the intestine to digest and absorb nutrients, suggesting a potential therapeutic role in the treatment of intestinal insufficiency. Indeed, several studies have now confirmed that GLP-2 administration reduces or prevents intestinal damage in rodent models of colitis, enteritis, total parenteral nutrition and massive resection. Very recently, phase 2 clinical trials of GLP-2 have also been reported, in which patients with short bowel syndrome were demonstrated to exhibit an enhanced ability to absorb enteral nutrients after 30 days of GLP-2 administration, with apparently no undesirable side effects.

The principal metabolic pathway for GLP-2 clearance is through enzymatic degradation. GLP-2 has been shown to be rapidly degraded through the removal of its two N-terminal amino acids by dipeptidylpeptidase-IV (DPP-IV), which represents a major limitation because it leads to the complete inactivation of the peptide. As a result, the half-life of GLP-2 is thus quite short, and current GLP-2 treatment necessitates infusion or frequent injections. Renal clearance has also been shown to be involved in the clearance of GLP-2. The major action of GLP-2 involves stimulation of cell growth, and the mechanism coupling GLP-2 receptor activation, directly or indirectly, to cell proliferation has not been examined.

It has been shown that peptide analogs of native GLP-2 possess enhanced trophic activity at the small intestine as GLP-2 receptor agonists (see for example U.S. Pat. No. 5,990,077).

Although very useful, a critical disadvantage of GLP-2 peptides and analogs, as stated above, is their very short half-lives in vivo, which is typically not more than 2 minutes.

Inflammatory Bowel Disease (IBD) is a group of chronic disorders that cause inflammation or ulceration in the small and large intestines. It may even be life threatening, and there is currently no known cure. IBD commonly refers to ulcerative colitis (UC), limited to the colon and Crohn's disease (CD) which can involve the entire gastrointestinal tract, resulting in a chronic cycle of remissions and flares. Many pharmaceutical products are known to treat IBD, for example to suppress inflammation, to prevent flare-ups, to control symptoms such as pain or diarrhea, or to replace or supplement essential nutrients that are poorly absorbed because of extensive disease or surgery. Current treatment options include a wide variety of pharmaceutical products like aminosalicylates, corticosteroids, immune modulators, and anti-TNF-α agent, and are designed to reduce inflammation and relieve symptoms in addition to replacing lost fluids and nutrients. Most of these products however have a limited use in IBD because of their undesirable side effects on the body in general.

Approximately one million patients are treated for IBD every year in the United States and Europe, most of them generally suffering from either Crohn's disease or ulcerative colitis. In fact, it is not uncommon for subjects suffering from IBD to undergo radical surgery involving the removal of major parts of the intestine. Direct annual healthcare costs of IBD are approximately $US 700 million, and the total economic impact of both direct and indirect costs approximate between $2 and $3 billion a year worldwide. Existing treatments, while often providing relief, have some shortcomings.

U.S. Pat. No. 5,789,379 teaches GLP-2 analogs among which one has been developed as a long-acting compound (ALX-600™) and is currently in clinical trials. However, even if DPP-IV degradation of GLP-2 appears to be somehow prevented, its half-life remains limited by renal clearance, and does not exceed 2 minutes, as stated above.

A chimeric antibody (Remicade™) has been developed to bind specifically to human tumor necrosis factor alpha (TNFα) for the short-term treatment of Crohn's. This antibody is indicated for the reduction of the symptoms of moderate to severe Crohn's disease in patients who have had an inadequate response to conventionnal therapy with corticosteroids, other immunosuppressants and/or antibiotics. Nevertheless, serious side effects are observed with such treatment. For example, it has been associated with hypersensitivity reaction, serious infections including sepsis, as well as fatal infections. Its administration could further predispose patients to infections through TNF-blocking.

With the prevalence of IBD increasing in recent years, it would therefore be highly desirable to develop GLP-2 peptide derivatives or analogs capable of substantially maintaining the same level of activity, low toxicity and therapeutic advantages as GLP-2, but with a much longer in vivo half-life, thus avoiding the necessity for continuous administration thereof in the treatment of various diseases such as inflammatory bowel disease, Crohn's disease and ulcerative colitis representing the two major inflammatory bowel diseases.

SUMMARY OF THE INVENTION

In accordance with the present invention, there is now provided a GLP-2 gastrointestinal tissue growth promoter derivative having an extended in vivo half-life when compared with the corresponding unmodified GLP-2 gastrointestinal growth promoter. More specifically, the GLP-2 derivative comprises a reactive entity coupled hereto and capable of reacting with available functionalities on a blood component, either in vivo or ex vivo, to form a stable covalent bond. The covalent bonding formed between the GLP-2 derivative and the blood component prevents undesirable cleavage of the GLP-2 by enzymes such as dipeptidylpeptidase IV, thereby extending its in vivo half-life and activity. The reactive entity may be on the N-terminal of the GLP-2 peptide, the C-terminal of the GLP-2 peptide, or on any other available site along the peptidic chain.

Preferred blood components comprise proteins such as immunoglobulins, including IgG and IgM, serum albumin, ferritin, steroid binding proteins, transferrin, thyroxin binding protein, α-2-macroglobulin, haptoglobin etc., serum albumin and IgG being more preferred, and serum albumin being the most preferred.

Preferred reactive entity are capable of forming a covalent bond with the blood component by reacting with amino groups, hydroxy groups or thiol groups present thereon, either in vivo or in vitro (or ex vivo). In a most preferred embodiment, the functionality on the protein will be a thiol group and the reactive entity will be a Michael acceptor, such as acrolein derivatives, haloacetates, haloacetamides, α,β-unsaturated ketones, α,β-unsaturated esters, α,β-unsaturated amides, α,β-unsaturated thioesters, and the like, maleimide or maleimido-containing group such as γ-maleimide-butyrylamide (GMBA) or maleimidopropionic acid (MPA), MPA being the most preferred.

In another aspect of the invention, there is provided a pharmaceutical composition comprising the present GLP-2 gastrointestinal tissue growth promoter derivative in combination with a pharmaceutically acceptable carrier. Such composition is useful for the treatment or prevention of bowel disorders or diseases such as inflammatory bowel disease and other gastrointestinal functions. The composition may also be used for gene therapy to induce cells to endogenously produce the gastrointestinal tissue growth promoter peptide derivative that may then be implanted in a subject to produce the desired biological effect. Finally, the composition may also be used for manufacturing pharmaceutical or veterinary compositions for the enhancement of large intestine tissue growth.

In a further embodiment of the present invention, there is provided a method for the treatment of prevention of bowel disorders or diseases such as inflammatory bowel disease, and gastrointestinal functions. The method comprises administering to a subject, preferably a mammal, animal or human, an effective amount of the present GLP-2 gastrointestinal tissue growth promoter derivative or a conjugate thereof, alone or in combination with a pharmaceutically acceptable carrier.

In a further aspect of the present invention, there is provided a conjugate comprising the present GLP-2 gastrointestinal tissue growth promoter derivative covalently bonded to a blood component.

In a further aspect of the present invention, there is provided a method for extending the in vivo half-life of a GLP-2 gastrointestinal tissue growth promoter in a subject, the method comprising covalently bonding the GLP-2 gastrointestinal tissue growth promoter derivative to a blood component. The covalent bonding may take place in vivo or in vitro.

Preferred gastrointestinal tissue growth promoter compounds are peptides such as GLP-2 and GLP-2 analogs, GLP-2 fragments, provided that such analog or fragment possesses gastrointestinal tissue growth promoting activity. Details of the sequences of these peptides, analogs and fragments are illustrated below.

A further use of the present compound derivative may be the determination of the intestinotrophic activity of a hormone when used in combination with the present compound derivative, and particularly when the compound is GLP-2, a GLP-2 analog or a GLP-2 fragment Such method comprises the steps of: (a) coadministering the hormone with an intestinotrophic amount of the GLP-2 derivative to a test subject; (2) assessing the subsequent growth of small and large intestine tissue in the test subject; and (3) determining whether the growth of small and/or large intestine tissue in the test subject is enhanced relative to control subjects treated with unmodified GLP-2, GLP-2 analog or GLP-2 derivative.

If a linking group is present, it is preferably defined as, without limitation, a straight or branched $C_{1-10}$ alkyl; a straight or branched $C_{1-10}$ alkyl partly or perfluorinated; a $C_{1-10}$ alkyl or fluoroalkyl wherein one or more carbon atom is replaced with O, N or S to form an ether or a thioether, o-, m- or p-disubstituted phenyl wherein the substituents are the same or different and are $CH_2$, O, S, NH, NR wherein R is H, $Cl_{1-10}$ alkyl or $C_{1-10}$ acyl; or disubstituted heterocycles such as furan, thiophene, pyran, oxazole, or thiazole.

IN THE DRAWINGS

DETAILED DESCRIPTION OF THE INVENTION

Figure 1:
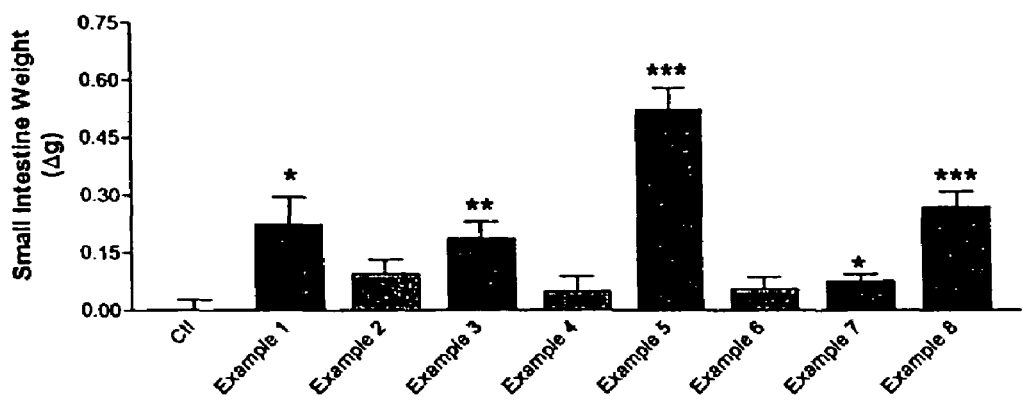
FIG. 1 illustrates the changes in small intestine wet weight in mice treated with saline or 5 μg of the compounds of Examples 1-8 twice daily, for 10 days (n=10/group). Results are expressed as mean delta weight vs. control±SEM.

In vivo bioconjugation is the process of covalently bonding a molecule, such as the present gastrointestinal tissue growth promoter compound derivative, within the body, to target blood components, preferably proteins, in a manner that permits the substantial retention, or increase in some instances, of the biological activity of the original unmodified GLP-2 gastrointestinal tissue growth promoter peptide therein, while providing an extended duration of the biological activity though giving the GLP-2 derivative the biophysical parameters of the target blood component.

For the purposes of the present invention, the terms "analog" or "fragment" are meant to include amino acid sequences comprising peptides with different amino acid sequences from the native sequence, such as the GLP-2 sequence, but with similar or comparable activity. Such analogs preferably have an amino acid sequence at least 60%, and more preferably at least 80%, and most preferably at least 95% the same as that of either GLP-2 or a fragment of GLP-2 having the same number of amino acid residues.

In a more preferred embodiment, the present gastrointestinal tissue growth promoter peptide derivative comprise a GLP-2 gastrointestinal tissue growth promoter peptide that has been modified by coupling thereto a reactive entity, either directly or via a linking group, the reactive entity being capable of forming a covalent bond with a blood component, preferably blood proteins. The reactive entity must be stable in an aqueous environment, and preferred embodiments thereof comprise carboxy group, a phosphoryl group, an imidate group, or an acyl group either as an ester or a mixed anhydride. The covalent bond is generally formed between the reactive entity and an amino group, a hydroxy group, or a thiol group on the blood component. The amino group preferably forms a covalent bond with reactive entities like carboxy, phosphoryl or acyl; the hydroxy group preferably forms a covalent bond with reactive entities like activated esters; and the thiol group preferably forms a covalent bond with reactive entities like esters or mixed anhydrides. The preferred blood component comprises mobile blood components like serum albumin, immunoglobulins, or combinations thereof, and the preferred reactive entity comprises anhydrides like maleimide groups. In a most preferred embodiment, the blood component is serum albumin.

The blood components are preferably mobile, which means that they do not have a fixed situs for any extended period of time, generally not exceeding 5 minutes, and more usually one minute. These blood components are not membrane-associated and are present in the blood for extended periods of time in a minimum concentration of at least 0.1 µg/ml. Preferred mobile blood components include serum albumin, transferrin, ferritin and immunoglobulins such as IgM and IgG. The half-life of mobile blood components is at least about 12 hours.

The present gastrointestinal tissue growth promoter derivative is a GLP-2 peptide, and therefore protective groups may be required during the synthesis process of the GLP-2 derivative. These protective groups are conventional in the field of peptide synthesis, and can be generically described as chemical moieties capable of protecting the peptide derivative from reacting with other functional groups. Various protective groups are available commercially, and examples thereof can be found in U.S. Pat. No. 5,493,007 which is hereby incorporated by reference. Typical examples of suitable protective groups include acetyl, fluorenylmethyloxycarbonyl (FMOC), t-butyloxycarbonyl (BOC), benzyloxycarbonyl (CBZ), etc. Table 1 provides both the three letter and one letter abbreviations for amino acids.

TABLE 1

NATURAL AMINO ACIDS AND THEIR ABBREVIATIONS

| Name | 3-letter abbreviation | 1-letter abbreviation |
| --- | --- | --- |
| Alanine | Ala | A |
| Arginine | Arg | R |
| Asparagine | Asn | N |
| Aspartic acid | Asp | D |
| Cysteine | Cys | C |
| Glutamic acid | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The present GLP-2 derivative forms a peptidase-stabilized peptide after conjugation to a blood component. It is also contemplated that one or more additional amino acids may be added or substituted to the peptide prior to addition of the reactive entity, to facilitate the coupling thereof to the peptide. Such addition or substitution may be made at the N-terminal, the C-terminal, or therebetween. The thus obtained peptide derivative may be administered to a subject, animal or human, such that conjugation with blood components occurs in vivo, or they may be first conjugated to blood components of the subject, animal or human, in vitro, and the resulting conjugate, or peptidase-stabilized peptide as defined below, administered to the subject.

Any amino acid, present, substituted with or added to, the GLP-2 sequence, may be D-amino acids or L-amino acids or combinations thereof. L-amino acids are generally preferred. A glycine substitution at position 2 of the native GLP-2 sequence represents a preferred embodiment, because it confers to the analog a greater resistance to DPP-IV enzyme. Glycine may also be replaced with D-alanine or proline for that same purpose. In addition, a N-α-methyl aspartic acid substitution at position 3 of the native GLP-2 sequence can achieve the same result, as well as other peptide mimetics such as methyl amino, hydroxyl ethyl, hydrazino, ethylene or sulfonamide as isosteric replacement of the amide bond.

The invention also includes GLP-2 fragments which, although containing a sequence that is substantially homologous to that of a naturally occurring GLP-2 peptide, may lack one or more additional amino acids at their amino and/or their carboxy termini that are naturally found on a GLP-2 native peptide. Thus, the invention pertains to polypeptide fragments of GLP-2 that may lack one or more amino acids that are normally present in a naturally occurring GLP-2 sequence provided that such polypeptides have gastrointestinal tissue growth promoting activity which preferably at least substantially equals that of GLP-2.

The invention also encompasses the obvious or trivial variants of the above-described analogs or fragments which have inconsequential amino acid substitutions (and thus have amino acid sequences which differ from that of the natural sequence) provided that such variants have gastrointestinal tissue growth promoting activity which is substantially similar to that of GLP-2. Examples of obvious or trivial substitutions include the substitution of one basic residue for another (i.e. Arg for Lys), the substitution of one hydrophobic residue for another (i.e. Leu for Ile), or the substitution of one aromatic residue for another (i.e. Phe for Tyr), etc. Further, other trivial variants include analogs wherein conservative substitutions resulting in a substantial structural analogy of the original sequence are obtained. Examples of such conservative substitutions, without limitation, include glutamic acid for aspartic acid and vice-versa; glutamine for asparagine and vice-versa; serine for threonine and vice-versa; lysine for arginine and vice-versa; or any of isoleucine, valine or leucine for each other.

A peptidase-stabilized GLP-2 derivative is more stable in the presence of peptidases in vivo than the corresponding non-stabilized GLP-2 analog. The peptidase stability is determined by comparing the half-life of the native GLP-2 analog in serum or blood to the half-life of the corresponding derivative containing the reactive entity in serum or blood. Half-life is determined by sampling the serum or blood after administration of the derivative and the non-modified peptide, and determining the activity of each compound.

In greater details, the present invention is directed to the modification of GLP-2 and analogs and fragments thereof to improve its bioavailability, extend in vivo half-life and distribution through selective conjugation onto a blood component while substanitally maintaining or improving their remarkable therapeutic properties.

Human GLP-2 is known to have the following sequence:
His-Ala-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp (SEQ ID NO: 1).

The invention relates to therapeutic and related uses of GLP-2 derivatives having an extended half-life in vivo, particularly to

- promote the growth of small and/or large intestine tissue;
- elevate blood levels of GLP-2 derivative;
- restore or maintain gastrointestinal function;
- promote the healing and regrowth of injured or ulcerated/inflamed intestinal mucosa;
- reduce the risk of enteric disease;
- enhance the nutritional status;
- treat or prevent nutritional or gastrointestinal disorders or diseases;
- reduce weight loss;
- reduce interleukin-1 expression;
- increase colon length, both mucosal area and integrity in the colon, and crypt depth;
- promote villous growth in subjects suffering from a disease such as celiac disease, post-infectious villous atrophy and short gut syndromes;
- promote proliferation of the small and large intestine in a healthy subject, for example to enable increased absorption of nutrients in cattle allowing earlier weaning or increased milk and meat production; etc.

The effect on growth elicited by the present GLP-2 derivatives manifests as an increase in small bowel weight, relative to a mock-treated control. In particular, the present GLP-2 derivatives are considered to have "intestinotrophic" activity if, when assessed in the murine model exemplified herein, the analog mediates an increase in small bowel weight of at least 10% relative to a control animal receiving vehicle alone. Particularly suitable for therapeutic use are those derivatives which mediate an increase of at least 20% in small bowel weight, while those more preferred mediate an increase in small bowel weight of 50% or more. Intestinotrophic activity is noted most significantly in relation to the jejunum, including the distal jejunum and particularly the proximal jejunum, and is also noted in the ileum.

In addition to exhibiting intestinotrophic activity, the present GLP-2 derivatives incorporate an amino acid substitution at one or more sites within a GLP-2 peptide "backbone", which is either a mammalian GLP-2 species per se, or is a variant of a mammalian GLP-2 species in which the C-terminus and/or the N-terminus has been altered by addition of one or two basic residues, or has been modified to incorporate a blocking group of the type used conventionally in the art of peptide chemistry to protect peptide termini from undesired biochemical attack and degradation in vivo. Thus, the present peptide derivatives incorporate an amino acid substitution in the context of any mammalian GLP-2 species, including but not limited to human GLP-2, bovine GLP-2, rat GLP-2, dog GLP-2, ox GLP-2, porcine GLP-2, guinea pig GLP-2 and hamster GLP-2, the sequences of which have been reported by many authors, including Buhl et al, J. Biol. Chem., 1988, 263(18):8621. In a more preferred embodiment, a lysine residue is added at the C-terminal of the GLP-2 peptide sequence.

In one aspect of the invention, the intestinotrophic analogs of GLP-2 suitable for derivatization according to the present invention are of the following sequence:
$R_1—(Y_1)_m—X_1—X_2—X_3—X_4—X_5$-Phe$_6$-Ser$_7$-Asp$_8$-$(P_1)—X_{14}$-Asp$_{15}$-$X_{16}—X_{17}$-Ala$_{18}$-$X_{19}—X_{20}—X_{21}$-Phe$_{22}$-$(P_2)$-Trp$_{25}$-Leu$_{26}$-$X_{27}—X_{28}$-Thr$_{29}$-Lys$_{30}$-$P_3$—$(Y_2)_n—R_2$ (SEQ ID NO: 2 and 29-252) wherein $X_1$ is His or Tyr;

$X_2$ is Ala, Gly, D-Ala, Pro, Ile, Nor-Val, α-aminobutyric acid, or an Ala-replacement amino acid conferring on said analog resistance to DPP-IV enzyme;

$X_3$ is Asp, Glu, Pro HPro; or $X_2—X_3$ are $X_2\psi(CH(OH)CH_2)X_3$, $X_2\psi(CH_2NH_2)X_3$ or $X_2\psi(CHCH)X_3$ wherein $X_2$ and $X_3$ are as defined above;

$X_4$ is Gly or Ala;

$X_5$ is Ser or Ala;

$P_1$ is Glu-$X_{10}$-Asn-Thr-Ile (SEQ ID NO: 253), Gly-$X_{10}$-Asn-Thr-Val (SEQ ID NO: 254) or Tyr-Ser-Lys-Tyr (SEQ ID NO: 255);

$X_{10}$ is Met, Leu, Ile or an oxidatively stable Met-replacement amino acid;

$X_{14}$ is Leu or Lys;

$X_{16}$ is Asn, Lys or Ala;

$X_{17}$ is Leu or Lys;

$X_{19}$ is Ala or Thr;

$X_{20}$ is Arg, Lys, His or Ala;

$X_{21}$ is Asp or Lys;

$X_{27}$ is Ile or Leu;

$X_{28}$ is Gln or His;

$P_2$ is Ile-Asn, Ile-Ala or Val-Gln;

$P_3$ is a covalent bond, or is Ile, Ile-Thr, Ile-Thr-Asp or Ile-Thr-Asn;

$R_1$ is $NH_2$ or a N-terminal blocking group;

$R_2$ is COOH, $CONH_2$ or a C-terminal blocking group;

$Y_1$ is one or two of Arg, Lys, and His;

$Y_2$ is one or two of Arg, Lys, and His; and m and n are independently 0 or 1.

In a preferred embodiment, $X_1$ is His; $X_2$ is Ala or Gly, $X_3$ is Asp; $X_4$ is Gly; $X_5$ is Ser; $P_1$ is Glu-$X_{10}$-Asn-Thr-Ile; $X_{10}$ is Met; $X_{16}$ is Asn or Lys; $X_{19}$ is Ala; $X_{20}$ is Arg; $X_{27}$ is Ile; $X_{28}$ is Gln; $P_2$ is Ile-Asn; $P_3$ is Ile-Thr-Asp, $R_2$ is $CONH_2$ and m is 0. In a further preferred embodiment, n is 1 and $Y_2$ is Lys.

In a preferred embodiment, the functionality on the protein will be a thiol group and the reactive entity will be a maleimide or maleimido-containing group such as γ-maleimide-butyrylamide (GMBA), maleimidopropionic acid (MPA), (2-amino)ethoxy acetic acid (AEA)-MPA, ethylenediamine (EDA)-MPA or 2-[2-2-amino)ethoxy)]ethoxy acetic acid (AEEA)-MPA and combinations thereof Examples of combinations include, without limitations, (AEEA-EDA)-MPA; (AEEA-AEEA)-MPA, (AEA-AEEA)-MPA and the like.

Maleimide groups are most selective for sulfhydryl groups on peptides when the pH of the reaction mixture is kept between 6.5 and 7.4. At pH 7.0, the rate of reaction of maleimido groups with sulfhydryls is 1000-fold faster than with amines. A stable thioether linkage between the maleimido group and the sulfhydryl is formed which cannot be cleaved under physiological conditions.

The gastrointestinal tissue growth promoter derivatives of the invention provide for specific labeling of blood components. Such specific labeling, particularly with a maleimide, offers several advantages. Free thiol groups are less abundant in vivo than amino groups, and as a result, maleimide derivatives covalently bond to fewer proteins. For example, in serum albumin, there is only one free thiol group per molecule. Thus, a GLP-2-maleimide-albumin conjugate will tend to comprise a 1:1 molar ratio of peptide to albumin. In addition to albumin, IgG molecules (class II) also have free thiols. Since IgG molecules and serum albumin make up the majority of soluble proteins in the blood, i.e., 99%, they also make up the majority of the free thiol groups available to covalently bond to a maleimide-substituted GLP-2.

Further, even among free thiol-containing blood proteins, specific labeling with a maleimide leads to the preferential formation of peptide maleimide-albumin conjugates, due to the unique characteristics of albumin itself. The single free thiol group of albumin, highly conserved among species, is located at amino acid residue $Cys_{34}$. It has been demonstrated recently that the $Cys_{34}$ of albumin has an increased reactivity relative to free thiols on other free thiol-containing proteins. This is due in part to the unusual pK value of 5.5 for the $Cys_{34}$ of albumin. This is much lower than typical pK values for cysteines residues in general, which are typically about 8. Due to this low pK, under normal physiological conditions, $Cys_{34}$ of albumin is predominantly in the anionic form, which dramatically increases its reactivity. In addition to the low pK value of $Cys_{34}$, another factor which enhances the reactivity of $Cys_{34}$ is its location, which is in a hydrophobic pocket close to the surface of one loop of region V of albumin. This location makes $Cys_{34}$ accessible to ligands of all kinds, and is an important factor in $Cys_{34}$'s biological role as free radical trap and free thiol scavenger. As a result, the reaction rate acceleration can be as much as 1000-fold relative to rates of reaction of peptide-maleimides with other free-thiol containing proteins.

Another advantage of peptide-maleimide-albumin conjugates is the reproducibility associated with the 1:1 loading of peptide to albumin specifically at $Cys_{34}$. Conventional activation techniques, such as with glutaraldehyde, DCC, EDC and other chemical activators of, for example, free amines, lack this selectivity. For example, albumin contains 52 lysine residues, 25-30 of which are located on the surface of albumin and accessible for conjugation. Activating these lysine residues, or alternatively modifying a peptide to couple through these lysine residues, results in a heterogeneous population of conjugates. Even if an equimolar ratio peptide:albumin (i.e., 1:1) is employed, the end result is the production of random conjugation products, some containing an indefinite number of peptides linked to each molecule of albumin, and each conjugate having peptides randomly coupled at any one of the 25-30 available lysine sites. Consequently, characterization of the exact composition is virtually impossible, not to mention the absence of reproducibility. Additionally, while it would seem that conjugation through lysine residues of albumin would at least have the advantage of delivering more therapeutic agent per albumin molecule, studies have shown that a 1:1 ratio of therapeutic agent to albumin is preferred. In an article by Stehle, et al. in *Anti-Cancer Drugs,* 1997 8, 677-685, which is incorporated herein in its entirety, it is reported that a 1:1 ratio of the anti-cancer methotrexate to albumin conjugated via glutaraldehyde gave the most promising results. These conjugates were taken up by tumor cells, whereas conjugates bearing 5:1 to 20:1 methotrexate molecules had altered HPLC profiles and were quickly taken up by the liver in vivo. It would therefore seems that at higher ratios, the effectiveness of albumin as a carrier for a therapeutic agent is diminished.

Through controlled administration of the present GLP-2 peptide derivative, and particularly a GLP-2 peptide comprising a maleimide reactive entity, specific in vivo labeling or bonding of albumin and IgG can be controlled. In typical administrations, it has been shown that 80-90% of the administered peptide derivative bonds to albumin and less than 5% bonds to IgG. Trace bonding of free thiols present, such as glutathione, also occurs. Such specific bonding is preferred for in vivo use as it permits an accurate calculation of the estimated half-life of the therapeutic agent administered.

Maleimide-substituted GLP-2 peptides are generally quite stable in the presence of aqueous solutions and in the presence of free amines. Because maleimide-substituted GLP-2 peptides react with free thiols, protective groups are not necessary to prevent them from reacting with themselves.

As stated above, the desired conjugates of GLP-2 derivatives to blood components may be prepared in vivo by administration of the derivatives directly to the subject, which may be an animal or a human. The administration may be done in the form of a bolus, or introduced slowly over time by infusion using metered flow or the like.

Alternately, the conjugate may also be prepared ex vivo by combining blood or commercially available purified blood components with the present GLP-2 derivative, allowing covalent bonding of the GLP-2 derivative to the functionalities on blood components, and then returning or administering the conjugated blood or conjugated purified blood component to the host. Moreover, the above may also be accomplished by first purifying an individual blood component or limited number of components, such as red blood cells, immunoglobulins, serum albumin, or the like, and combining the component or components ex vivo with the present compound derivative. The labeled blood or blood component may then be returned to the subject to provide in vivo the therapeutically effective conjugates. The blood also may be treated to prevent coagulation during handling ex vivo.

Peptide Synthesis

GLP-2 peptides may be synthesized by standard methods of solid phase peptide chemistry well known to any one of ordinary skill in the art. For example, the peptide may be synthesized by solid phase chemistry techniques following the procedures described by Steward et al. in *Solid Phase Peptide Synthesis,* 2nd Ed., Pierce Chemical Company, Rockford, Ill., (1984) using a Rainin PTI Symphony™ synthesizer. Similarly, peptides fragments may be synthesized and subsequently combined or linked together to form a larger peptide (segment condensation). These synthetic peptide fragments can also be made with amino acid substitutions and/or deletion at specific locations.

For solid phase peptide synthesis, a summary of the many techniques may be found in Stewart et al. in "*Solid Phase Peptide Synthesis*", W. H. Freeman Co. (San Francisco), 1963 and Meienhofer, *Hormonal Proteins and Peptides,* 1973, 2 46. For classical solution synthesis, see for example Schroder et al. in "*The Peptides*", volume 1, Academic Press (New York). In general, such method comprises the sequential addition of one or more amino acids or suitably protected amino acids to a growing peptide chain on a polymer. Normally, either the amino or carboxyl group of the first amino acid is protected by a suitable protecting group. The protected and/or derivatized amino acid is then either attached to an inert solid support or utilized in solution by adding the next amino acid in the sequence having the complimentary (amino or carboxyl) group suitably protected and under conditions suitable for forming the amide linkage. The protecting group is then removed from this newly added amino acid residue and the next amino acid (suitably protected) is added, and so forth.

After all the desired amino acids have been linked in the proper sequence, any remaining protecting groups (and any solid support) are cleaved sequentially or concurrently to afford the final peptide. By simple modification of this general procedure, it is possible to add more than one amino acid at a time to a growing chain, for example, by coupling (under conditions which do not racemize chiral centers) a protected tripeptide with a properly protected dipeptide to form, after deprotection, a pentapeptide (segment condensation).

A particularly preferred method of preparing the present GLP-2 derivatives involves solid phase peptide synthesis wherein the amino acid α-N-terminal is protected by an acid or base sensitive group. Such protecting groups should have the properties of being stable to the conditions of peptide linkage formation while being readily removable without destruction of the growing peptide chain or racemization of any of the chiral centers contained therein. Examples of N-protecting groups and carboxy-protecting groups are disclosed in Greene, "Protective Groups In Organic Synthesis," (John Wiley & Sons, New York pp. 152-186 (1981)), which is hereby incorporated by reference. Examples of N-protecting groups comprise, without limitation, loweralkanoyl groups such as formyl, acetyl ("Ac"), propionyl, pivaloyl, t-butylacetyl and the like; other acyl groups include 2-chloroacetyl, 2-bromoacetyl, trifluoroacetyl, trichloroacetyl, phthalyl, o-nitrophenoxyacetyl, -chlorobutyryl, benzoyl, 4-chlorobenzoyl, 4-bromobenzoyl, 4-nitrobenzoyl and the like; sulfonyl groups such as benzenesulfonyl, p-toluenesulfonyl, o-nitrophenylsulfonyl, 2,2,5,7,8-pentamethylchroman-6-sulfonyl (pmc), and the like; carbamate forming groups such as t-amyloxycarbonyl, benzyloxycarbonyl, p-chlorobenzyloxycarbonyl, p-methoxybenzyloxycarbonyl, p-nitrobenzyloxycarbonyl, 2-nitrobenzyloxycarbonyl, p-bromobenzyloxycarbonyl, 3,4-dimethoxybenzyloxycarbonyl, 3,5-dimethoxybenzyloxycarbonyl, 2,4-dimethoxybenzyloxycarbonyl, 4-ethoxybenzyloxycarbonyl, 2-nitro4,5-dimethoxybenzyloxycarbonyl, 3,4,5-trimethoxybenzyloxycarbonyl, 1-(p-biphenylyl)-1-methylethoxycarbonyl, α,α-dimethyl-3,5-dimethoxybenzyloxycarbonyl, benzhydryloxycarbonyl, t-butyloxycarbonyl (boc), diisopropylmethoxycarbonyl, isopropyloxycarbonyl, ethoxycarbonyl, methoxycarbonyl, allyloxycarbonyl, 2,2,2,-trichloroethoxycarbonyl, phenoxycarbonyl, 4-nitrophenoxycarbonyl, fluorenyl-9-methoxycarbonyl, isobornyloxycarbonyl, cyclopentyloxycarbonyl, adamantyloxycarbonyl, cyclobexyloxycarbonyl, phenylthiocarbonyl and the like; arylalkyl groups such as benzyl, biphenylisopropyloxycarbonyl, triphenylmethyl, benzyloxymethyl, 9-fluorenylmethyloxycarbonyl (Fmoc) and the like and silyl groups such as trimethylsilyl and the like. Preferred α-N-protecting group are o-nitrophenylsulfenyl; 9-fluorenylmethyloxycarbonyl; t-butyloxycarbonyl (boc), isobornyloxycarbonyl; 3,5-dimethoxybenzyloxycarbonyl; t-amyloxycarbonyl; 2-cyano-t-butyloxycarbonyl, and the like, 9-fluorenylmethyloxycarbonyl (Fmoc) being more preferred, while preferred side chain N-protecting groups comprise 2,2,5,7,8-pentamethylchroman-6-sulfonyl (pmc), nitro, p-toluenesulfonyl, 4-methoxybenzene-sulfonyl, Cbz, Boc, and adamantyloxycarbonyl for side chain amino groups like lysine and arginine; benzyl, o-bromobenzyloxycarbonyl, 2,6-dichlorobenzyl, isopropyl, t-butyl (t-Bu), cyclohexyl, cyclopenyl and acetyl (Ac) for tyrosine; t-butyl, benzyl and tetrahydropyranyl for serine; trityl, benzyl, Cbz, p-toluenesulfonyl and 2,4-dinitrophenyl for histidine; formyl for tryptophan; benzyl and t-butyl for aspartic acid and glutamic acid; and triphenylmethyl (trityl) for cysteine.

A carboxy-protecting group conventionally refers to a carboxylic acid protecting ester or amide group. Such carboxy protecting groups are well known to those skilled in the art, having been extensively used in the protection of carboxyl groups in the penicillin and cephalosporin fields as described in U.S. Pat. Nos. 3,840,556 and 3,719,667, the disclosures of which are hereby incorporated herein by reference. Representative carboxy protecting groups comprise, without limitation, $C_1$-$C_8$ loweralkyl; arylalkyl such as phenethyl or benzyl and substituted derivatives thereof such as alkoxybenzyl or nitrobenzyl groups; arylalkenyl such as phenylethenyl; aryl and substituted derivatives thereof such as 5-indanyl; dialkylaminoalkyl such as dimethylaminoethyl; alkanoyloxyalkyl groups such as acetoxymethyl, butyryloxymethyl, valeryloxymethyl, isobutyryloxymethyl, isovaleryloxymethyl, 1-(propionyloxy)-1-ethyl, 1-(pivaloyloxy)-1-ethyl, 1-methyl-1(propionyloxy)-1-ethyl, pivaloyloxymethyl, propionyloxymethyl; cycloalkanoyloxyalkyl groups such as cyclopropylcarbonyloxymethyl, cyclobutylcarbonyloxymethyl, cyclopentylcarbonyloxymethyl, cyclohexylcarbonyloxy-methyl; aroyloxyalkyl such as benzoyloxymethyl, benzoyloxyethyl; arylalkylcarbonyloxyalkyl such as benzylcarbonyloxymethyl, 2-benzylcarbonyloxyethyl; alkoxycarbonylalkyl or cycloalkyloxycarbonylalkyl such as methoxycarbonylmethyl, cyclohexyloxycarbonylmethyl, 1-methoxycarbonyl-1-ethyl; alkoxycarbonyloxyalkyl or cycloalkyloxycarbonyloxyalkyl such as methoxycarbonyloxymethyl, t-butyloxycarbonyl-oxymethyl, 1-ethoxycarbonyloxy-1-ethyl, 1-cyclohexyloxycarbonyloxy-1-ethyl; aryloxy-carbonyloxyalkyl such as 2-(phenoxycarbonyloxy) ethyl, 2-(5-indanyloxycarbonyloxy)-ethyl; alkoxyalkylcarbonyloxyalkyl such as 2-(1-methoxy-2-methylpropan-2-oyloxy)-ethyl; arylalkyloxycarbonyloxyalkyl such as 2-(benzyloxycarbonyloxy)ethyl; arylalkenyloxycarbonyloxyalkyl such as 2-(3-phenylpropen-2-yloxycarbonyloxy)ethyl; alkoxycarbonylaminoalkyl such as t-butyloxycarbonylaminomethyl; alkylaminocarbonyl-aminoalkyl such as methylaminocarbonylaminomethyl; alkanoylaminoalkyl such as acetylaminomethyl; heterocycliccarbonyloxyalkyl such as 4-methylpiperazinyl-carbonyloxymethyl; dialkylaminocarbonylalkyl such as dimethylaminocarbonylmethyl, diethylaminocarbonylmethyl; (5-(loweralkyl)-2-oxo-1,3-dioxolen4-yl)alkyl such as (5-t-butyl-2-oxo-1,3-dioxolen4-yl) methyl; and (5-phenyl-2-oxo-1,3-dioxolen4-yl)alkyl such as (5-phenyl-2-oxo-1,3-dioxolen4-yl)methyl. Representative amide carboxy protecting groups comprise, without limitation, aminocarbonyl and loweralkylaminocarbonyl groups. Of the above carboxy-protecting groups, loweralkyl, cycloalkyl or arylalkyl ester, for example, methyl ester, ethyl ester, propyl ester, isopropyl ester, butyl ester, sec-butyl ester, isobutyl ester, amyl ester, isoamyl ester, octyl ester, cyclohexyl ester, phenylethyl ester and the like or an alkanoyloxyalkyl, cycloalkanoyloxyalkyl, aroyloxyalkyl or an arylalkylcarbonyloxyalkyl ester are preferred. Preferred amide carboxy protecting groups are loweralkylaminocarbonyl groups.

In the solid phase peptide synthesis method, the α-C-terminal amino acid is attached to a suitable solid support or resin. Suitable solid supports useful for the above synthesis are those materials that are inert to the reagents and reaction conditions of the stepwise condensation-deprotection reactions, as well as being insoluble in the media used. The preferred solid support for synthesis of α-C-terminal carboxy peptides is 4-hydroxymethylphenoxyacetyl-4'-methylbenzy-hydrylamine resin (HMP resin). The preferred solid support for α-C-terminal amide peptides Fmoc-protected Ramage Resin.

When the solid support is 4-2',4'-dimethoxyphenyl-Fmoc-aminomethyl)-phenoxy-acetamidoethyl resin, the Fmoc group is cleaved with a secondary amine, preferably piperidine, prior to coupling with the α-C-terminal amino acid as described above. The preferred method for coupling to the deprotected 4-2',4'-dimethoxyphenyl-Fmoc-aminomethyl) phenoxy-acetamidoethyl resin is O-benzotriazol-1-yl-N,N,N',N'-tetramethyluroniumhexafluoro-phosphate (HBTU, 1 equiv.), diisopropylethylamine (DIEA, 1 equiv.), and optionally 1-hydroxybenzotriazole (HOBT, 1 equiv.), in DMF. The coupling of successive protected amino acids can be carried out in an automatic polypeptide synthesizer in a conventional manner as is well known in the art.

The removal of the Fmoc protecting group from the α-N-terminal side of the growing peptide is accomplished conventionally, for example, by treatment with a secondary amine, preferably piperidine. Each protected amino acid is then introduced in about 3-fold molar excess, and the coupling is preferably carried out in DMF. The coupling agent is normally O-benzotriazol-1-yl-N,N,N',N'-tetramethyluronium-hexafluoro-phosphate (HBTU, 1 equiv.), diisopropylethy-lamine (DIEA, 1 equiv.), and optionally 1-hydroxybenzotriazole (HOBT, 1 equiv.).

At the end of the solid phase synthesis, the peptide is removed from the resin and deprotected, either in successive operations or in a single operation. Removal of the polypeptide and deprotection can be accomplished conventionally in a single operation by treating the resin-bound polypeptide with a cleavage reagent comprising thioanisole, triisopropyl-silane, phenol, and trifluoroacetic acid. In cases wherein the α-C-terminal of the polypeptide is an alkylamide, the resin is cleaved by aminolysis with an alkylamine. Alternatively, the peptide may be removed by transesterification, e.g. with methanol, followed by aminolysis or by direct transamidation. The protected peptide may be purified at this point or taken to the next step directly. The removal of the side chain protecting groups is accomplished using the cleavage mixture described above. The fully deprotected peptide can be purified by a sequence of chromatographic steps employing any or all of the following types: ion exchange on a weakly basic resin (acetate form); hydrophobic adsorption chromatography on underivatized polystyrene-divinylbenzene (such as Amberlite XAD™); silica gel adsorption chromatography, ion exchange chromatography on carboxymethylcellulose; partition chromatography, e.g. on Sephadex G-25™, LH-20™ or countercurrent distribution; high performance liquid chromatography (HPLC), especially reverse-phase HPLC on octyl- or octadecylsilyl-silica bonded phase column packing. Anyone of ordinary skill in the art will be able to determine easily what would be the preferred chromatographic steps or sequences required to obtain acceptable purification of the GLP-2 peptide.

Molecular weights of these peptides are determined using Quadrupole Electro Spray mass spectroscopy.

The synthesis process for the production of the GLP-2 derivatives of the present invention will vary widely, depending upon the nature of the various elements, i.e., the GLP-2 sequence, the linking group and the reactive entity, comprised in the GLP-2 derivative. The synthetic procedures are selected to ensure simplicity, high yields and repetitivity, as well as to allow for a highly purified product. Normally, the chemically reactive entity will be coupled at the last stage of the synthesis, for example, with a carboxyl group, esterification to form an active ester. Specific methods for the production of the present GLP-2 derivatives are described below.

It is imperative that the chemically reactive entity be placed at a site to allow the peptide to covalently bond to the blood component while retaining a substantial proportion, if not all, activity and/or beneficial effects of the corresponding native GLP-2 peptide.

In a more preferred embodiment, each GLP-2 derivative will be synthesized according to the following criteria: if a terminal carboxylic group is available on the peptide and is not critical for the retention of pharmacological activity, and no other sensitive functional group is present on the peptide, then the carboxylic acid will be chosen as attachment point for the linking group-reactive entity modification. If the terminal carboxylic group is involved in pharmacological activity, or if no carboxylic acids are available, then any other sensitive functional group not critical for the retention of pharmacological activity will be selected as the attachment point for the linking group-reactive entity modification. If several sensitive functional groups are available on a peptide, a combination of protecting groups will be used in such a way that after addition of the linking group/reactive entity and deprotection of all the protected sensitive functional groups, retention of pharmacological activity is still obtained. If no sensitive functional groups are available on the peptide, synthetic efforts will allow for a modification of the original peptide in such a way that retention of biological activity and retention of receptor or target specificity is obtained. In this case the modification should preferably occur at the opposite end of the peptide.

According to the present invention, the GLP-2 derivatives can be administered to patients that would benefit from growth of the tissue of the upper gastrointestinal tract In addition, patients who would benefit from increased upper gastrointestinal tract tissue function, whether as a result of increased tissue growth or not, are candidates for treatment with the invention. In general, patients who would benefit from either increased upper gastrointestinal tract mass and/or increased upper gastrointestinal tract mucosal function are candidates for treatment with the present GLP-2 peptide derivatives. Particular conditions that may be treated with the present GLP-2 peptide derivatives include the various forms of inflammatory diseases of the stomach or esophagus, as well as patients who have undergone partial or sub-total resection of the upper gastrointestinal tract. A non-exhaustive list of conditions of the upper gastrointestinal tract including the stomach and esophagus, that may be treated by the present GLP-2 derivatives or mixtures thereof, comprises disorders of the stomach like acute gastritis, acute hemorrhagic gastritis, acute stress gastritis, viral gastritis, parasitic gastritis, fungal gastritis, gastropathy (acute), hemorrhagic gastropathy, acute *helicobacter pylori* gastritis, type A, B or C gastritis, hypersecretory gastritis, non specific gastritis secondary to *Helicobacter pylori, Helicobacter pylori*-associated gastritis, chemical gastritis, reactive gastritis, reflux gastritis, bile gastritis, metaplastic atrophic gastritis and environmental metaplastic atrophic gastritis, idiopathic pangastritis, diffuse corporal gastritis, autoimmune chronic gastritis and autoimmune-associated gastritis, bacterial gastritis other than *helicobacter pilori (Gastrospirillum hominis,* phlegmonous, mycobacterial, syphiltic), postantrectomy atrophic gastritis, eosinophilic gastritis, and any other acute infectious gastritis;

Crohn's disease, sarcoidosis, isolated granulomatous gastritis, lymphocylic gastritis, Menetriere's disease, etc., and disorders of the esophagus like infectious esophagitis from fungi like *Candida* species (esp. *albicans*), *Aspargillus* sp., *Histoplasma capsulatum*, *Blastomyces dermatitides*, or from viruses like herpes simplex virus (type 1), cytomegalovirus, *Varicella-zoster* virus, or from bacteria like *Mycobacterium tuberculosis, Actinomyces Israelii, Streptococcus viridans, Lactobacillus acidophilus,* and *Treponema pallidum*. Other disorders of the esophagus include, without limitation, non-infectious esophagitis, acid reflux, bile reflux, chemical injury (caused by medicines, toxins, acids, alkali etc.), sarcoidosis, Crohn's disease, Behcet's disease, Graft-versus-host disease, AIDS Related Infections (*Cryptosporidium* sp., *Microsporidium* sp., *Isospora beill, Glardia Lamblia, Salmonella* sp., *Shigella* sp., *Campylobacter* sp., *Mycobacterium tuberculosis, Mycobacterium avium* complex, *Clostridium difficile,* Cytomeglavorius and Herpes simplex.

Other diseases or conditions that can be treated with the present GLP-2 peptide derivatives include abnormalities in the small intestinal tract mucosa, which include ulcers and inflammatory disorders; congenital or acquired digestion and absorption disorders including malabsorption syndromes; and diseases and conditions caused by loss of small intestine mucosal function particularly in patients undergoing extended parenteral feeding or who, as a result of surgery, have undergone resection of the small intestine and suffer from short-gut syndrome and cul-de-sac syndrome. In general, patients who would benefit from either increased small intestinal mass and consequent increased small intestine mucosal function are candidates for treatment with GLP-2 peptide derivatives. Particular conditions that may be treated with the present GLP-2 derivatives include the various forms of sprue including celiac sprue which results from a toxic reaction to gliadin from wheat, and is marked by a tremendous loss of villae of the small intestine; tropical sprue which results from infection and is marked by partial flattening of the villae; hypogammaglobulinemic sprue which is observed commonly in patients with common variable immunodeficiency or hypogammaglobulinemia and is marked by significant decrease in villus height. Other conditions that may be treated with the present derivatives, or for which they may be useful prophylactically, include radiation enteritis, infectious or post-infectious enteritis, regional enteritis (Crohn's disease), small intestinal damage due to toxic or other chemo-therapeutic agents, and patients with short bowel syndrome.

In another aspect, patient candidates for treatment with the present GLP-2 peptide derivatives are those who would benefit from growth of pancreatic islets, and particularly from proliferation or regeneration of pancreatic islets. Such patients include those suffering from diseases or conditions marked by the absence or reduction of pancreatic islets or by reduced pancreatic islet function. Particular patient candidates are those suffering from type 1 or type 2 diabetes, as well as patients with secondary forms of diabetes due to infiltration, inflammation or destruction of the pancreas.

The present GLP-2 derivatives may be used alone or in combination to optimize their therapeutic effects. They can be administered in a physiologically acceptable medium, e.g. deionized water, phosphate buffered saline (PBS), saline, aqueous ethanol or other alcohol, plasma, proteinaceous solutions, mannitol, aqueous glucose, alcohol, vegetable oil, or the like. Other additives which may be included include buffers, where the media are generally buffered at a pH in the range of about 5 to 10, where the buffer will generally range in concentration from about 50 to 250 mM, salt, where the concentration of salt will generally range from about 5 to 500 mM, physiologically acceptable stabilizers, and the like. The compositions may be lyophilized for convenient storage and transport.

The present peptide derivatives may be administered orally, parenterally, such as intravascularly (IV), intraarterially (IA), intramuscularly (IM), subcutaneously (SC), or the like. Administration may in appropriate situations be by transfusion. In some instances, where reaction of the functional group is relatively slow, administration may be oral, nasal, rectal, transdermal or aerosol, where the nature of the conjugate allows for transfer to the vascular system. Usually a single injection will be employed although more than one injection may be used, if desired. The peptide derivative may be administered by any convenient means, including syringe, trocar, catheter, or the like. The particular manner of administration will vary depending upon the amount to be administered, whether a single bolus or continuous administration, or the like. Preferably, the administration will be intravascularly, where the site of introduction is not critical to this invention, preferably at a site where there is rapid blood flow, e.g., intravenously, peripheral or central vein. Other routes may find use where the administration is coupled with slow release techniques or a protective matrix. The intent is that the peptides be effectively distributed in the blood, so as to be able to react with the blood components. The concentration of the conjugate will vary widely, generally ranging from about 1 µg/ml to 50 mg/ml. Typically, the total administered intravascularly may generally be in the range of about 0.1 mg/ml to about 10 mg/ml, more usually about 1 mg/ml to about 5 mg/ml.

By bonding to long lived components of the blood, such as immunoglobulin, serum albumin, red blood cells and platelets, a number of advantages ensue. The activity of the present GLP-2 derivatives is extended for days, and potentially up to weeks. Only one administration needs to be given during this period of time. Greater specificity can be achieved, since the active compound will be primarily bonded to large molecules, where it is less likely to be taken up intracellularly to interfere with other physiological processes.

The blood of the mammalian host may be monitored for the activity of GLP-2 and/or presence of the GLP-2 derivatives. By taking a blood sample from the host at different times, one may determine whether the GLP-2 peptide has become bonded to the long-lived blood components in sufficient amount to be therapeutically active and, thereafter, the level of GLP-2 in the blood. If desired, one may also determine to which of the blood components the GLP-2 peptide is covalently bonded. For specific maleimide-substituted peptides, it is much simpler to calculate the half-life of serum albumin and IgG. Monitoring may also take place by using assays of peptide activity, HPLC-MS or antibodies directed to peptides.

Another aspect of this invention relates to methods for determining the concentration of the GLP-2 peptide or its conjugate in biological samples (such as blood) using antibodies specific to the GLP-2 peptide and to the use of such antibodies as a treatment for toxicity potentially associated with such GLP-2 peptide or conjugate. This is advantageous because the increased stability and life of the GLP-2 peptide in vivo in the patient might lead to novel problems during treatment, including increased possibility for toxicity. The use of anti-GLP-2 antibodies, either monoclonal or polyclonal, having specificity for GLP-2, can assist in mediating any such problem. The antibody may be generated or derived from a host immunized with the particular GLP-2 derivative, or with an immunogenic fragment of the agent, or a synthesized immunogen corresponding to an antigenic determinant of the agent. Preferred antibodies will have high specificity and affinity for native, derivatized and conjugated forms of the GLP-2 peptide derivative. Such antibodies can also be labeled with enzymes, fluorochromes, or radiolabels.

Antibodies specific for the GLP-2 derivatives may be produced by using purified GLP-2 peptides for the induction of derivatized GLP-2-specific antibodies. By induction of antibodies, it is intended not only the stimulation of an immune response by injection into animals, but analogous steps in the production of synthetic antibodies or other specific binding molecules such as screening of recombinant immunoglobulin libraries. Both monoclonal and polyclonal antibodies can be produced by procedures well known in the art.

The antibodies may also be used to monitor the presence of the GLP-2 peptide in the blood stream. Blood and/or serum samples may be analyzed by SDS-PAGE and western blotting. Such techniques permit the analysis of the blood or serum to determine the bonding of the GLP-2 derivative to blood components.

The anti-therapeutic agent antibodies may also be used to treat toxicity induced by administration of the GLP-2 derivative, and may be used ex vivo or in vivo. Ex vivo methods would include immuno-dialysis treatment for toxicity employing anti-therapeutic agent antibodies fixed to solid supports. In vivo methods include administration of anti-therapeutic agent antibodies in amounts effective to induce clearance of antibody-agent complexes.

The antibodies may be used to remove the GLP-2 derivatives and conjugates thereof, from a patient's blood ex vivo by contacting the blood with the antibodies under sterile conditions. For example, the antibodies can be fixed or otherwise immobilized on a column matrix and the patient's blood can be removed from the patient and passed over the matrix. The GLP-2 derivatives will bind to the antibodies and the blood containing a low concentration of GLP-2, then may be returned to the patient's circulatory system. The amount of GLP-2 derivative removed can be controlled by adjusting the pressure and flow rate. Preferential removal of the GLP-2 derivative from the serum component of a patient's blood can be effected, for example, by the use of a semipermeable membrane, or by otherwise first separating the serum component from the cellular component by ways known in the art prior to passing the serum component over a matrix containing the anti-therapeutic antibodies. Alternatively the preferential removal of GLP-2-conjugated blood cells, including red blood cells, can be effected by collecting and concentrating the blood cells in the patient's blood and contacting those cells with fixed anti-GLP-2 antibodies to the exclusion of the serum component of the patient's blood.

The anti-GLP-2 antibodies can be administered in vivo, parenterally, to a patient that has received the GLP-2 derivative or conjugates for treatment. The antibodies will bind the GLP-2 derivative and conjugates. Once bound, the GLP-2 activity will be hindered if not completely blocked thereby reducing the biologically effective concentration of GLP-2 derivative in the patient's bloodstream and minimizing harmful side effects. In addition, the bound antibody-GLP-2 complex will facilitate clearance of the GLP-2 derivative and conjugates from the patient's blood stream.

The following examples are provided to illustrate preferred embodiments of the invention and shall by no means be construed as limiting its scope. Unless indicated otherwise, optically active protected amino acids in the L-configuration were used.

Synthesis

The synthesis of the GLP-2 peptides and derivatives thereof was performed using an automated solid-phase procedure on a Symphony™ peptide synthesizer with manual intervention during the generation of the GLP-2 derivatives. The synthesis was performed on Fmoc-protected Ramage™ amide linker resin using Fmoc-protected amino acids. Coupling was achieved by using O-benzotriazol-1-yl-N,N,N',N'-tetramethyl-uronium hexafluorophosphate (HBTU) as activator in N,N-dimethylformamide (DMF) solution and diisopropylethylamine (DIEA) as base. The Fmoc protective group was removed using 20% piperidine/DMF. When needed, a Boc-protected amino acid was used at the N-terminus in order to generate the free $N_\alpha$-terminus after the peptide was cleaved from the resin. All amino acids used during the synthesis possessed the L-stereochemistry unless otherwise stated. Glass reaction vessels were Sigmacoted™ and used during the synthesis.

EXAMPLE 1

His-Ala-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 3)

Step 1: Solid phase peptide synthesis was carried out on a 100 μmole scale. The following protected amino acids were sequentially added to resin: Fmoc-Asp(tBu)-OH, Fmoc-Thr(tBu)-OH, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Asp(tBu)-OH, Fmoc-Arg(Pbf)-OH, Fmoc-Ala-OH, Fmoc-Ala-OH, Fmoc-Leu-OH, Fmoc-Asn(Trt)-OH, Fmoc-Asp(tBu)-OH, Fmoc-Leu-OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)-OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Ala-OH, Boc-His(Boc)-OH. They were dissolved in N,N-dimethylformamide (DMF) and, according to the sequence, activated using O-benzotriazol-1-yl-N,N,N',N'-tetramethyl-uronium hexafluorophosphate (HBTU) and diisopropylethylamine (DIEA). Removal of the Fmoc protecting group was achieved using a solution of 20% (V/V) piperidine in N,N-dimethylformamide (DMF) for 20 minutes.

Step 2: The peptide was cleaved from the resin using 85% TFA/5% TIS/5% thioanisole and 5% phenol, followed by precipitation by dry-ice cold (0-4° C.) Et$_2$O. The crude peptide was collected on a polypropylene sintered funnel, dried, redissolved in a 40% mixture of acetonitrile in water (0.1% TFA) and lyophilized to generate the corresponding crude material used in the purification process.

EXAMPLE 2

MPA-His-Ala-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 4)

Step 1: Solid phase peptide synthesis was carried out on a 100 μmole scale. The following protected amino acids were sequentially added to resin: Fmoc-Asp(tBu)-OH, Fmoc-Thr(tBu)-OH, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Asp(tBu)-OH, Fmoc-Arg(Pbf)-OH, Fmoc-Ala-OH, Fmoc-Ala-OH, Fmoc-Leu-OH, Fmoc-Asn(Trt)-OH, Fmoc-Asp(tBu)-OH, Fmoc-Leu-OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)-OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Ala-OH, Fmoc-His(Trt)-OH, MPA-OH.

Step 2: This step was performed in the same manner as step 2 of Example 1.

EXAMPLE 3

His-Ala-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(MPA)-CONH$_2$ (SEQ ID NO: 5)

Step 1: This step was performed in the same manner as step 1 of Example 1 above, except that the first amino acid added to the resin was Fmoc-Lys(Aloc)-OH.

Step 2: The selective deprotection of the Lys (Aloc) group was performed manually and accomplished by treating the resin with a solution of 3 eq of Pd(PPh$_3$)$_4$ dissolved in 5 mL of C$_6$H$_6$:CHCl$_3$ (1:1): 2.5% NMM (v:v):5% AcOH (v:v) for 2 h. The resin is then washed with CHCl$_3$ (6×5 mL), 20% AcOH in DCM (6×5 mL), DCM (6×5 mL), and DMF (6×5 mL).

Step 3: The synthesis was then re-automated for the addition of the 3-maleimidopropionic acid. Between every coupling, the resin was washed 3 times with N,N-dimethylformamide (DMF) and 3 times with isopropanol.

Step 4: The peptide was cleaved from the resin using 85% TFA/5% TIS/5% thioanisole and 5% phenol, followed by precipitation by dry-ice cold (0-4° C.) Et$_2$O. The crude peptide was collected on a polypropylene sintered funnel, dried, redissolved in a 40% mixture of acetonitrile in water (0.1% TFA) and lyophilized to generate the corresponding crude material used in the purification process.

EXAMPLE 4

His-Ala-Asp-Gly-Ser-Phe-Ser-Asp-Glu-Met-Asn-Thr-Ile-Leu-Asp-Lys(MPA)-Leu-Ala-Ala-Arg -Asp-Phe-Ile-Asn-Trp-Leu-Ile-Gln-Thr-Lys-Ile-Thr-Asp-CONH$_2$ (SEQ ID NO: 6)

Step 1: Solid phase peptide synthesis was carried out on a 100 μmole scale. The followingprotected amino acids were sequentially added to resin following the procedure described in step 1 of Example 1: Fmoc-Asp(tBu)-OH, Fmoc-Thr(tBu)-OH, Fmoc-Ile-OH, Fmoc-Lys(Boc)-OH, Fmoc-Thr (tBu)-OH, Fmoc-Gln(Trt)-OH, Fmoc-Ile-OH, Fmoc-Leu-OH, Fmoc-Trp(Boc)-OH, Fmoc-Asn (Trt)-OH, Fmoc-Ile-OH, Fmoc-Phe-OH, Fmoc-Asp(tBu)-OH, Fmoc-Arg(Pbf)-OH, Fmoc-Ala -OH-OH, Fmoc-Ala-OH-OH, Fmoc-Leu-OH, Fmoc-Lys(Aloc)-OH, Fmoc-Asp (tBu)-OH, Fmoc -Leu-OH, Fmoc-Ile-OH, Fmoc-Thr (tBu)-OH, Fmoc-Asn(Trt)-OH, Fmoc-Met-OH, Fmoc-Glu(tBu) -OH, Fmoc-Asp(tBu)-OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Ala-OH-OH, Boc-His(Boc)-OH.

Steps 2-4: These steps were performed in the same manner as steps 2-4 of Example 3.

EXAMPLE 5

His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 7)

Step 1: Solid phase peptide synthesis was carried out on a 100 μmole scale. The following protected amino acids were sequentially added to resin following the procedure described in step 1 of Example 1: Fmoc-Asp(tBu)-OH, Fmoc-Thr(tBu)-OH, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Asp(tBu)-OH, Fmoc-Arg(Pbf)-OH, Fmoc-Ala-OH, Fmoc-Ala-OH, Fmoc-Leu-OH, Fmoc-Asn(Trt)-OH, Fmoc-Asp(tBu)-OH, Fmoc-Leu-OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Gly-OH, Boc-His(Boc)-OH.

Step 2: This step was performed in the same manner as step 2 of Example 1.

EXAMPLE 6

MPA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$(SEQ ID NO: 8)

Step 1: This step was performed in the same manner as step 1 as in Example 2 except that the alanine residue in position 2 has been replaced with a glycine.

Step 2: This step was performed in the same manner as step 2 of Example 1.

EXAMPLE 7

His-Gly-Asp-Gly-Ser-Phe-Ser-Asp-Glu-Met-Asn-Thr-Ile-Leu-Asp-Lys(MPA)-Leu-Ala-Ala-Arg -Asp-Phe-Ile-Asn-Trp-Leu-Ile-Gln-Thr-Lys-Ile-Thr-Asp-CONH$_2$ (SEQ ID NO: 9)

Step 1: Solid phase peptide synthesis was carried out on a 100 μmole scale. The following protected amino acids were sequentially added to resin following the procedure described in step 1 of Example 1: Fmoc-Asp(tBu)-OH, Fmoc-Thr(tBu)-H, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Asp(tBu)-OH, Fmoc-Arg(Pbf)-OH, Fmoc-Ala-OH, Fmoc-Ala-OH, Fmoc-Leu-OH, Fmoc-Lys(Aloc)-OH, Fmoc-Asp(tBu)-OH, Fmoc-Leu-OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)-OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Gly-OH, Boc-His(Boc)-OH.

Steps 2-4: These steps were performed in the same manner as steps 2-4 of Example 3.

EXAMPLE 8

His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(MPA)-CONH$_2$ (SEQ ID NO: 10)

Step 1: This step was performed in the same mannner as step 1 of Example 5 above, except that the first amino acid added to the resin was Fmoc-Lys(Aloc)-OH.

Steps 2-4: These steps were performed in the same manner as steps 2-4 of Example 3.

EXAMPLE 9

His-Gly-Asp-Gly-Ser-Phe-Ser-Asp-Glu-Met-Asn-Thr-Ile-Leu-Asp-Lys(AEEA-MPA)-Leu-Ala-Ala-Arg-Asp-Phe-Ile-Asn-Trp-Leu-Ile-Gln-Thr-Lys-Ile-Thr-Asp-CONH$_2$ (SEQ ID NO: 11)

Step 1: This step was performed in the same manner as step 1 of Example 7.

Step 2: The selective deprotection of the Lys (Aloc) group was performed manually and accomplished by treating the resin with a solution of 3 eq of Pd(PPh$_3$)$_4$ dissolved in 5 mL of C$_6$H$_6$ :CHCl$_3$ (1:1): 2.5% NMM (v:v):5% AcOH (v:v) for 2 h. The resin is then washed with CHCl$_3$ (6×5 mL), 20% AcOH in DCM (6×5 mL), DCM (6×5 mL), and DMF (6×5 mL).

Step 3: The synthesis was then re-automated for the addition of the Fmoc-AEEA-OH (Fmoc-aminoethoxyethoxy acetic acid). Between every coupling, the resin was washed 3 times with N,N-dimethylformamide (DMF) and 3 times with isopropanol. After proper deprotection, the MPA (3-maleimidopropionic acid) was anchored to the spacer and again the resin was washed 3 times with N,N-dimethylformamide (DMF) and 3 times with isopropanol.

Step 4: The peptide was cleaved from the resin using 85% TFA/5% TIS/5% thioanisole and 5% phenol, followed by precipitation by dry-ice cold (0-4° C) Et$_2$O. The crude peptide was collected on a polypropylene sintered funnel, dried, redissolved in a 40% mixture of acetonitrile in water (0.1% TFA) and lyophilized to generate the corresponding crude material used in the purification process.

EXAMPLE 10

His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(AEEA-MPA)-CONH$_2$ (SEQ ID NO: 12)

Step 1: This step was performed in the same manner as step 1 of Example 5 above, except that the first amino acid added to the resin was Fmoc-Lys(Aloc)-OH.

Steps 2-4: These steps were performed in the same manner as steps 2-4 of Example 9.

EXAMPLE 11

MPA-AEEA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 13)

Step 1: This step was performed in the same manner as step 1 of Example 6 except that Fmoc-AEEA-OH is added to the resin prior to MPA-OH at the end of the synthesis.

Step 2: This step was performed in the same manner as step 2 of Example 1.

EXAMPLE 12

MPA-AEEA-His-Ala-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 14)

Step 1: This step was performed in the same manner as step 1 of Example 1 except that Fmoc-AEEA-OH is added to the resin prior to MPA-OH at the end of the synthesis.

Step 2: This step was performed in the same manner as step 2 of Example 1.

EXAMPLE 13

His-Ala-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(AEEA-MPA)-CONH$_2$ (SEQ ID NO: 15)

Step 1: This step was performed in the same manner as step 1 of Example 1 above, except that the first amino acid added to the resin was Fmoc-Lys(Aloc)-OH.

Steps 2-4: These steps were performed in the same manner as steps 2-4 of Example 9.

EXAMPLE 14

His-Ala-Asp-Gly-Ser-Phe-Ser-Asp-Glu-Met-Asn-Thr-Ile-Leu-Asp-Lys(AEEA-MPA)-Leu-Ala-Ala-Arg-Asp-Phe-Ile-Asn-Trp-Leu-Ile-Gln-Thr-Lys-Ile-Thr-Asp-CONH$_2$ (SEQ ID NO: 16)

Step 1: This step was performed in the same manner as step 1 of Example 4.

Steps 2-4: These steps were performed in the same manner as steps 2-4 of Example 9.

EXAMPLE 15

His-Ala-Asp-Gly-Ser-Phe-Ser-Asp-Glu-Met-Asn-Thr-Ile-Leu-Asp-Asn-Lys(MPA)-Ala-Ala-Arg-Asp-Phe-Ile-Asn-Trp-Leu-Ile-Gln-Thr-Lys-Ile-Thr-Asp-CONH$_2$ (SEQ ID NO: 17)

Step 1: Solid phase peptide synthesis was carried out on a 100 µmole scale. The following protected amino acids were sequentially added to resin following the procedure described in step 1 of Example 1: Fmoc-Asp(tBu)-OH, Fmoc-Thr(tBu)-OH, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Asp(tBu)-OH, Fmoc-Arg(Pbf)-OH, Fmoc-Ala-OH, Fmoc-Ala-OH, Fmoc-Lys(Aloc)-OH, Fmoc-Asn(Trt)-OH, Fmoc-Asp(tBu)-OH, Fmoc-Leu-OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)-OH, Fmoc-Ser(tBu)-OH, Fmoc-Phe-OH, Fmoc-Ser(tBu)-OH, Fmoc-Gly-OH, Fmoc-sp(tBu)-OH, Fmoc-Ala-OH, Boc-His(Boc)-OH.

Steps 2-4: These steps were performed in the same manner as steps 2-4 of Example 3.

EXAMPLE 16

His-Ala-Asp-Gly-Ser-Phe-Ser-Asp-Glu-Met-Asn-Thr-Ile-Lys(MPA)-Asp-Asn-Leu-Ala-Ala-Arg -Asp-Phe-Ile-Asn-Trp-Leu-Ile-Gln-Thr-Lys-Ile-Thr-Asp-CONH$_2$ (SEQ ID NO: 18)

Step 1: Solid phase peptide synthesis was carried out on a 100 µmole scale. The following protected amino acids were sequentially added to resin following the procedure described in step 1 of Example 1: Fmoc-Asp(tBu)-OH, Fmoc-Thr(tBu)-OH, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Asp(tBu)-OH, Fmoc-Arg(Pbf)-OH, Fmoc-Ala-OH, Fmoc-Ala-OH, Fmoc-Leu-OH, Fmoc-Asn(Trt)-OH, Fmoc-Asp(tBu)-OH, Fmoc-Lys(Aloc)OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)-OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Ala-OH, Boc-His(Boc)-OH.

Steps 2-4: These steps were performed in the same manner as steps 2-4 of Example 3.

EXAMPLE 17

His-Ala-Asp-Gly-Ser-Phe-Ser-Asp-Glu-Met-Asn-Thr-Ile-Leu-Asp-Asn-Leu-Ala-Ala-Arg -Lys(MPA)-Phe-Ile-Asn-Trp-Leu-Ile-Gln-Thr-Lys-Ile-Thr-Asp-CONH$_2$ (SEQ ID NO: 19)

Step 1: Solid phase peptide synthesis was carried out on a 100 µmole scale. The following protected amino acids were sequentially added to resin following the procedure described in step 1 of Example 1: Fmoc-Asp(tBu)-OH, Fmoc-Thr(tBu)-OH, Fmoc-Ile-OH, Fmoc-Lys(Boc)-OH, Fmoc-Thr(tBu)-OH, Fmoc-Gln(Trt)-OH, Fmoc-Ile-OH, Fmoc-Leu-OH, Fmoc-Trp(Boc)-OH, Fmoc-Asn(Trt)-OH, Fmoc-Ile-OH, Fmoc-Phe-OH, Fmoc-Lys(Aloc)-OH, Fmoc-Arg(Pbf)-OH, Fmoc-Ala-OH, Fmoc-Ala-OH, Fmoc-Leu-OH, Fmoc-Asn(Trt)-OH, Fmoc-Asp(tBu)-OH, Fmoc-Leu-OH, Fmoc-Ile-OH, Fmoc-Thr(tBu)-OH, Fmoc-Asn(Trt)-OH, Fmoc-Met-OH, Fmoc-Glu(tBu)-OH, Fmoc-Asp(tBu)-OH, Fmoc-Ser(tBu)-OH, Fmoc-Phe-OH, Fmoc-Ser(tBu)-OH, Fmoc-Gly-OH, Fmoc-Asp(tBu)-OH, Fmoc-Ala-OH, Boc-His(Boc)-OH.

Steps 2-4: These steps were performed in the same manner as steps 2-4 of Example 3.

EXAMPLE 18

His-Ala-Asp-Gly-Ser-Phe-Ser-Asp-Glu-Met-Asn-Thr-Ile-Leu-Asp-Asn-Lys(AEEA-MPA)-Ala-Ala-Arg-Asp-Phe-Ile-Asn-Trp-Leu-Ile-Gln-Thr-Lys-Ile-Thr-Asp-CONH$_2$ (SEQ ID NO: 20)

Step 1: This step was performed in the same manner as step 1 of Example 15.
Steps 2-4: These steps were performed in the same manner as steps 2-4 of Example 9.

EXAMPLE 19

His-Ala-Asp-Gly-Ser-Phe-Ser-Asp-Glu-Met-Asn-Thr-Ile-Lys(AEEA-MPA)-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 21)

Step 1: This step was performed in the same manner as step 1 of Example 16.
Steps 2-4: These steps were performed in the same manner as steps 2-4 of Example 9.

EXAMPLE 20

His-Ala-Asp-Gly-Ser-Phe-Ser-Asp-Glu-Met-Asn-Thr-Ile-Leu-Asp-Asn-Leu-Ala-Ala-Arg-Lys(AEEA-MPA)-Phe-Ile-Asn-Trp-Leu-Ile-Gln-Thr-Lys-Ile-Thr-Asp-CONH$_2$ (SEQ ID NO: 22)

Step 1: This step was performed in the same manner as step 1 of Example 17.
Steps 2-4: These steps were performed in the same manner as steps 2-4 of Example 9.

Purification Procedure:

Each compound was purified by preparative reversed phase HPLC, using a Varian (Dynamax) preparative binary HPLC system. The purification was performed using a Phenomenex Luna 10µ phenyl-hexyl, 50 mm×250 mm column (particles 10µ) equilibrated with a water/TFA mixture (0.1% TFA in H$_2$O (solvent A) and acetonitrile/TFA (0.1% TFA in CH$_3$CN (solvent B). Elution was achieved at 50 mL/min by running a 28-38% B gradient over 180 min. Fractions containing peptide were detected by UV absorbance (Varian Dynamax UVD II) at 214 and 254 nm.

The fractions were collected in 25 mL aliquots. Those containing the desired product were identified by mass detection after direct injection onto LC/MS. The selected fractions were subsequently analyzed by analytical HPLC (20-60% B over 20 min; Phenomenex Luna 5µ phenyl-hexyl, 10 mm×250 nm column, 0.5 mL/min) to identify fractions with >90% purity for pooling. The pool was freeze-dried using liquid nitrogen and subsequently lyophilized for at least 2 days to yield a white powder.

In vivo Results

The intestinotrophic activity of the compounds of Examples 1-8 has been evaluated in a normal mice model. Five-week-old male CD-1 mice (20-25 g) were treated twice daily for 10 consecutive days with 5 µg/dose of each compound dissolved in 0.9% NaCl aqueous solution. The compounds were administered via subcutaneous injections in the dorsal-lateral area of the lumbar region. Control animals received 0.25 ml/dose of 0.9% NaCl.

On day 11, mice were fasted for 4 hours and anesthetized with $CO_2$. Small intestines were removed, cleaned and weighed. Significant increases in the small intestine weight were observed in animals treated with the compounds of Examples 1, 3, 5, 7 and 8. The results are shown in FIG. 1. As it can be seen, more pronounced intestinotrophic effects were obtained with the compounds of Examples 5, 7 and 8, stabilized with a glycine residue in position 2, when compared to the native GLP-2 peptides of Examples 1 and 3.

Dose-Response with Selected Gly2-GLP-2 Analogues

Six-week-old female CD-1 mice (20-25 g) were treated twice daily for 10 consecutive days with 5, 25 or 50 µg/dose of the compounds of Examples 5, 7 and 8. The compounds were dissolved in 0.083M sodium phosphate buffer, pH 6.8 and administered via subcutaneous injections in the dorsal-lateral area of the lumbar region. Control animals received 0.25 ml/dose of sodium phosphate buffer.

On day 11, fed mice were anesthetized with Halothane™ and small intestine, large intestine and stomach were collected from each mouse after laparatomy. The tissues were then cleaned and weighed.

Figure 2:
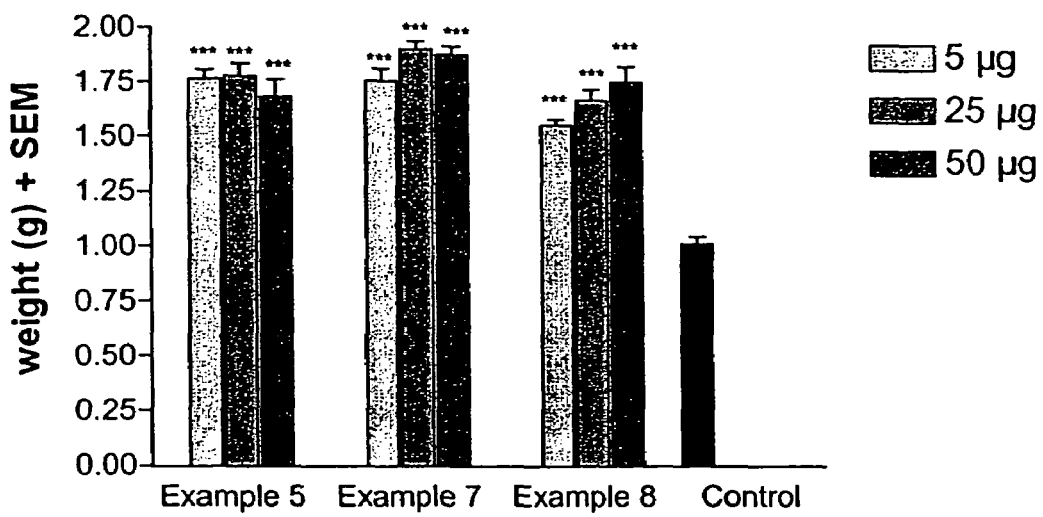
FIG. 2 illustrates changes in small intestine and large intestine wet weight in mice treated with saline or 5, 25 or 50 μg of the compounds of Examples 5, 7 and 8, twice daily, for 10 days (n=10/group). Results are expressed as mean weight±SEM.
Figure 2:
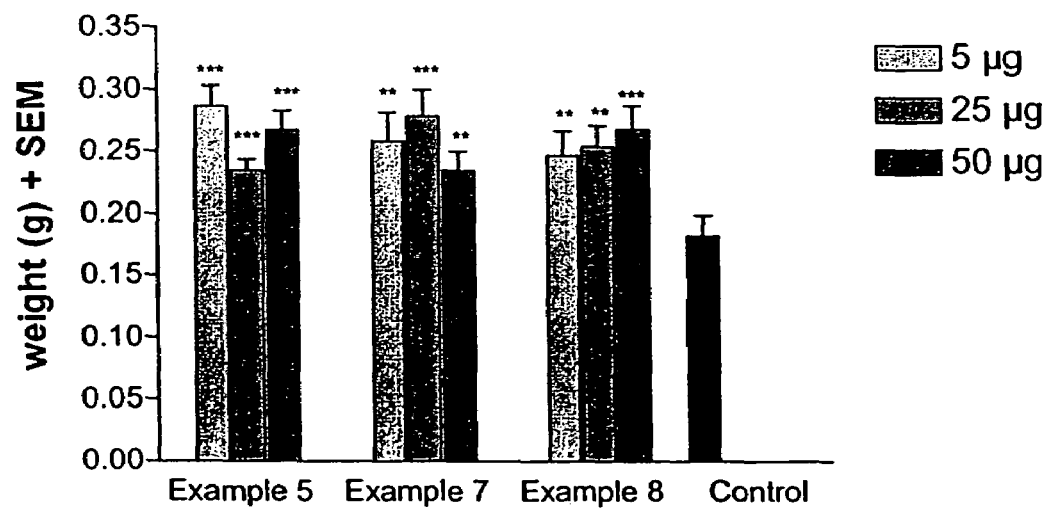

Statistically significant increases (53% to 88%) in the weight of the small intestine were demonstrated in all of the treatment groups as compared to control mice (see FIG. 2). No dose-response, however, was observed with the compounds of Examples 5 and 7, although a possible dose-response was noted for the compound of Example 8.

The weight of the large intestine was increased by 27 to 48% for all treatment groups. Again, no dose-response was observed for the compounds of Examples 5 and 7, while a possible dose-response was noted for the compound of Example 8 (see FIG. 2).

These results demonstrate that the GLP-2 derivatives of Examples 7 and 8 display intestinotropic activities similar to the corresponding free peptide of Example 5.

Pharmacokinetic Profiles in Rats

The pharmacokinetic profiles of the compounds of Examples 5 and 8 were studied in normal rats following a single intravenous or subcutaneous injection. Plasma concentrations were determined by radioimmunoassay with a commercial antibody anti-human GLP-2.

Animal Experimentation

Test articles were dissolved in 0.083M sodium phosphate buffer, pH 6.8 and administered to eight to eleven-week-old male Sprague-Dawley rats by a single intravenous or subcutaneous injection at a dose level of 500 nmol/kg. Serial blood samples (I50-200 µl) were collected into tubes containing EDTA and DPP-IV inhibitor at the following time-points: pre-dose, 5 and 30 min., and 1, 2, 4, 8, 24, 48, 72 and 96 hours post-test agent administration. Whole blood was centrifuged and subsequent plasma samples were recovered and stored at −80° C. until analysis.

Plasma Analysis

The plasma concentrations of the compounds of Examples 5 and 8 were determined by radioimmunoassay using a rabbit polyclonal antibody anti-human GLP-2 (Peninsula Laboratories, RGG7167) and iodinated human GLP-2 as tracer.

Pharmacokinetic Analysis

Descriptive pharmacokinetic parameters were determined by standard model-independent methods (Gibaldi and Perrier, 1982) based on the analysis of plasma concentration-time data. Pharmacokinetic analyses were performed using macros written for Microsoft Excel 97. The following parameters were calculated:

$C_{max}$ is the maximum plasma concentration;
$T_{max}$ is the time when $C_{max}$ is observed;
$T_{1/2}$ is the terminal half-life;
AUC(0-inf) is the area under the plasma concentration-time curve from time zero to time infinity;
F is the absolute bioavailability,
CL is the systemic clearance;
MRT is mean residence time; and
Vss is the steady-state volume of distribution.

Figure 3:
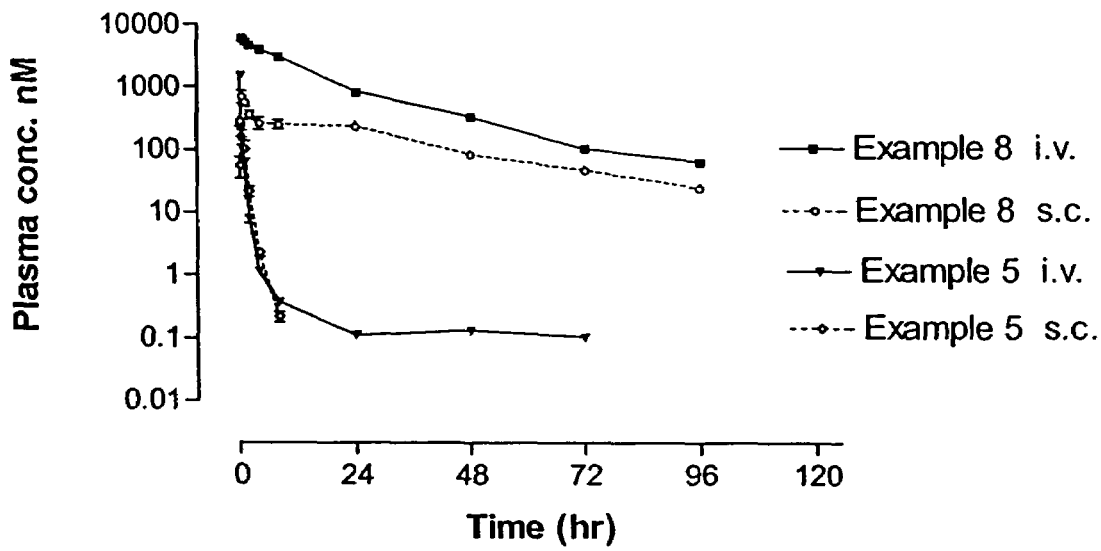
FIG. 3 illustrates the mean plasma concentrations for the compounds of Examples 5 and 8 in Sprague-Dawley rats following a single 500 nmol/kg intravenous or subcutaneous dose (n=4/group).

The plasma concentration profiles are shown in FIG. 3 and corresponding pharmacokinetic parameters are presented in Table 2 below. These results show that the GLP-2 derivatized according to the present invention effectively reduces the elimination and distribution of corresponding free Gly$^2$GLP-2 peptide, thereby producing greater plasma concentration and longer half-life in the systemic circulation.

TABLE 2

Comparison of the mean pharmacokinetic parameters of the compounds of Examples 5 and 8 in Sprague-Dawley rats following a single 500 nmol/kg dose

| | Parameter | | | |
| --- | --- | --- | --- | --- |
| | Compound of Example 5 | | Compound of Example 8 | |
| | Dose (nmol/kg) | | | |
| Route | 500 IV | 500 SC | 500 IV | 500 SC |
| $C_{max}$ (nM) | 1563.44 | 159.35 | 10108.42 | 650.93 |
| $T_{max}$ (h)[a] | N/A | 0.50 | N/A | 0.50 |
| AUC(0-inf) (nM/h) | 626.03 | 205.43 | 89354.35 | 13543.56 |
| CL (mL/min/kg) | 13.89 | N/A | 0.0942 | N/A |
| Vss (L/kg) | 0.2500 | N/A | 0.0953 | N/A |
| MRT (h) | 0.3 | N/A | 16.9 | N/A |
| $T_{1/2}$ (h)[b] | 1.5 | 0.9 | 16.2 | 23.8 |
| F (%) | N/A | 32.8 | N/A | 15.2 |

[a]expressed as media
[b]expressed as harmonic mean

Immunoblotting

Plasma samples obtained from the rat pharmacokinetic study were analyzed by immunoblotting. Plasma proteins were separated under non-reducing conditions using sodium-dodecyl-sulfate polyacrylamide gel electrophoresis (SDS-PAGE) according to Laemmli (1970). Plasma samples were first diluted 1:10 with distilled water and 20 µl was mixed with 10 µl of 3× Laemmli buffer (30 mM TrisCl, 3 mM EDTA, 15% SDS, pH 6.8) and 2 µl of bromophenol blue solution (0.1% bromophenol blue, 50% glycerol). Mixtures were placed in a boiling water bath for 3 min and loaded on gel. Proteins were first concentrated in a 3% stacking gel and then migrated through 8% separating gel using a mini-gel system with 10-well combs (1.5×4.8 mm). Electrophoresis was run under constant current at 15 mA/gel to concentrate proteins in stacking gel and at 20 mA/gel in separating gel for approximately 1.5 h.

Proteins were subsequently transferred onto a nitrocellulose membrane using a semi-dry transfer apparatus, for 1 hour at 100 mA/gel. Transfer efficacy was checked by reversible staining of the membrane with 1% red Ponceau™ solution.

Immunochemical Detection

Membranes were saturated overnight at 4° C. with Tris Buffered Saline (TBS) containing 5% low fat milk. After 3 washes with TBS-0.05% Tween 20™ for 5 min, blots were incubated for 90 min. at room temperature with rabbit polyclonal antibody anti-GLP-2 (Peninsula Lab. RGG7167) diluted 1:2,500 in TBS-0.5% Tween 20™ containing 1% plasma rat. Blots were washed 3 times for 10 min with TBS-0.05% Tween 20™ and subsequently incubated for one hour at room temperature with a peroxidase-labelled donkey anti-rabbit IgG (Jackson, 711-036-152) diluted 1:100,000 in TBS-0.05% Tween 20™. After 3 washes, revelation was performed using a chemioluminescent substrate of peroxidase (ECL™ kit Amersham Pharmacia Biotech). Films were exposed for 5 to 10 min.

Membrane were alternatively incubated with a peroxidase-labelled rabbit anti-rat albumin (Accurate Chemical, YN-RRaALBP) diluted 1:400,000 in TBS-0.05% Tween 20™ for 1 hour. After 3 washes with TBS-0.05% Tween 20™, revelation was performed as described above.

Results

A preliminary screening demonstrated that the commercial antibody anti-GLP-2 was not sensitive enough to detect the compound of Example 7 conjugated to proteins by Western-blotting. Consequently, only plasma samples of rats injected with the compound of Example 8 were analyzed by this method.

Figure 4:
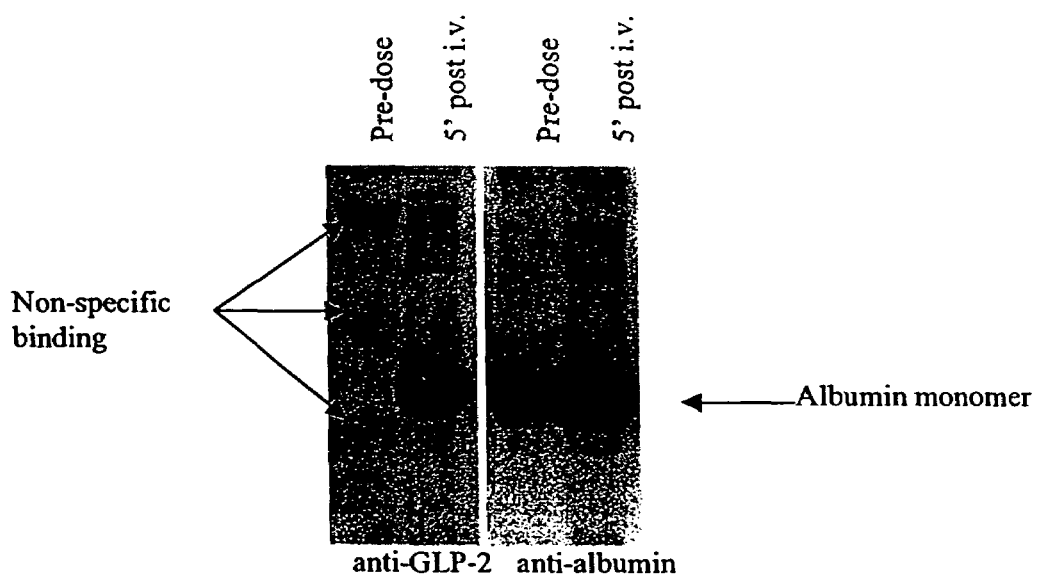
FIG. 4 illustrates detection of the compound of Example 8 conjugated to rat plasma proteins using a polyclonal antibody anti-GLP-2 antibody and comparison to the pattern obtained with an anti-rat albumin.

The results illustrated in FIG. 4 demonstrate that the compound of Example 8 conjugates efficiently to rat albumin post-iv administration. A weak signal was also observed on albumin post-sc administration (not shown). Comparison with an anti-rat albumin antibody indicates that most of the bands detected by the anti-GLP-2 antibody, except one, are attributable to various albumin species (monomers, dimers and polymers).

While the invention has been described in connection with specific embodiments thereof, it will be understood that it is capable of further modifications, and this application is intended to cover any variations, uses or adaptations of the invention following, in general, the principles of the invention, and including such departures from the present description as come within known or customary practice within the art to which the invention pertains, and as may be applied to the essential features hereinbefore set forth, and as follows in the scope of the appended claims.

SEQUENCE LISTING (258 sequences)

SEQ ID NO: 1 - protein, 33 aa, Human
HADGSFSDEMNTILDNLAARDFINWLIQTKITD

SEQ ID NO: 2 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (norvaline),alpha- aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (32)...(32): Xaa = Asp or Asn, with a COOH, CONH2 or a C-terminal blocking group
XXXXXFSDYSKYXDXXAXXXFVQWLXXTKITX

SEQ ID NO: 3 - protein, 33 aa, Artificial Sequence; identical to SEQ ID NO: 1
  analog of GLP-2
  AMIDATION (33)...(33)

SEQ ID NO: 4 - protein, 33 aa, Artificial Sequence; identical to SEQ ID NO: 1
  analog of GLP-2
  VARIANT (1)...(1): MPA attached to the His residue
  AMIDATION (33)...(33)

SEQ ID NO: 5 - protein, 34 aa, Artificial Sequence
  analog of GLP-2
  VARIANT (34)...(34): MPA attached to the Lys residue
  AMIDATION (34)...(34)
HADGSFSDEMNTILDNLAARDFINWLIQTKITDK

SEQ ID NO: 6 - protein, 33 aa, Artificial Sequence
  analog of GLP-2
  VARIANT (16)...(16): MPA attached to the Lys residue
  AMIDATION (33)...(33)
HADGSFSDEMNTILDKLAARDFINWLIQTKITD

SEQ ID NO: 7 - protein, 33 aa, Artificial Sequence
  analog of GLP-2
  AMIDATION (33)...(33)
HGDGSFSDEMNTILDNLAARDFINWLIQTKITD

SEQ ID NO: 8 - protein, 33 aa, Artificial Sequence; identical to SEQ ID NO: 7
  analog of GLP-2
  VARIANT (1)...(1): MPA attached to the His residue
  AMIDATION (33)...(33)

SEQ ID NO: 9 - protein, 33 aa, Artificial Sequence
  analog of GLP-2
  VARIANT (16)...(16): MPA attached to the Lys residue
  AMIDATION (33)...(33)
HGDGSFSDEMNTILDKLAARDFINWLIQTKITD

SEQ ID NO: 10 - protein, 34 aa, Artificial Sequence
  analog of GLP-2
  VARIANT (34)...(34): MPA attached to the Lys residue
  AMIDATION (34)...(34)
HGDGSFSDEMNTILDNLAARDFINWLIQTKITDK

SEQ ID NO: 11 - protein, 33 aa, Artificial Sequence; identical to SEQ ID NO: 9
  analog of GLP-2
  VARIANT (16)...(16): AEEA-MPA attached to the Lys residue
  AMIDATION (33)...(33)

SEQ ID NO: 12 - protein, 34 aa, Artificial Sequence; identical to SEQ ID NO: 10
  analog of GLP-2
  VARIANT (34)...(34): AEEA-MPA attached to the Lys residue
  AMIDATION (34)...(34)

SEQ ID NO: 13 - protein, 33 aa, Artificial Sequence; identical to SEQ ID NO: 7
  analog of GLP-2
  VARIANT (1)...(1): MPA-AEEA attached to the His residue
  AMIDATION (33)...(33)

SEQ ID NO: 14 - protein, 33 aa, Artificial Sequence; identical to SEQ ID NO: 1
  analog of GLP-2
  VARIANT (1)...(1): MPA-AEEA attached to the His residue
  AMIDATION (33)...(33

SEQ ID NO: 15 - protein, 34 aa, Artificial Sequence; identical to SEQ ID NO: 5
  analog of GLP-2
  VARIANT (34)...(34): AEEA-MPA attached to the Lys residue
  AMIDATION (34)...(34)

SEQ ID NO: 16 - protein, 33 aa, Artificial Sequence; identical to SEQ ID NO: 6
  analog of GLP-2
  VARIANT (16)...(16): AEEA-MPA attached to the Lys residue
  AMIDATION (33)...(33)

SEQ ID NO: 17 - protein, 33 aa, Artificial Sequence
  analog of GLP-2
  VARIANT (17)...(17): MPA attached to the Lys residue
  AMIDATION (33)...(33)
HADGSFSDEMNTILDNKAARDFINWLIQTKITD

SEQ ID NO: 18 - protein, 33 aa, Artificial Sequence
  analog of GLP-2
  VARIANT (14)...(14): MPA attached to the Lys residue
  AMIDATION (33)...(33)
HADGSFSDEMNTIKDNLAARDFINWLIQTKITD

SEQ ID NO: 19 - protein, 33 aa, Artificial Sequence
  analog of GLP-2
  VARIANT (21)...(21): MPA attached to the Lys residue
  AMIDATION (33)...(33)
HADGSFSDEMNTILDNLAARKFINWLIQTKITD

SEQ ID NO: 20 - protein, 33 aa, Artificial Sequence; identical to SEQ ID NO: 17
  analog of GLP-2
  VARIANT (17)...(17): AEEA-MPA attached to the Lys residue
  AMIDATION (33)...(33)

SEQ ID NO: 21 - protein, 33 aa, Artificial Sequence; identical to SEQ ID NO: 18
  analog of GLP-2
  VARIANT (14)...(14): AEEA-MPA attached to the Lys residue
  AMIDATION (33)...(33)

SEQ ID NO: 22 - protein, 33 aa, Artificial Sequence; identical to SEQ ID NO: 19
  analog of GLP-2
  VARIANT (21)...(21): AEEA-MPA attached to the Lys residue
  AMIDATION (33)...(33)

SEQ ID NO: 23 - protein, 34 aa, Artificial Sequence; identical to SEQ ID NO: 10
  analog of GLP-2
  AMIDATION (34)...(34)

SEQ ID NO: 24 - protein, 33 aa, Artificial Sequence; identical to SEQ ID NO: 6
  analog of GLP-2
  AMIDATION (33)...(33)

SEQ ID NO: 25 - protein, 33 aa, Artificial Sequence; identical to SEQ ID NO: 9
  analog of GLP-2
  AMIDATION (33)...(33)

SEQ ID NO: 26 - protein, 33 aa, Artificial Sequence; identical to SEQ ID NO: 17
  analog of GLP-2
  AMIDATION (33)...(33)

SEQ ID NO: 27 - protein, 33 aa, Artificial Sequence; identical to SEQ ID NO: 18
  analog of GLP-2
  AMIDATION (33)...(33)

SEQ ID NO: 28 - protein, 33 aa, Artificial Sequence; identical to SEQ ID NO: 19
  analog of GLP-2
  AMIDATION (33)...(33)

SEQ ID NO: 29 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXFSDEXNTIXDXXAXXXFIXWLXXTK

SEQ ID NO: 30 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (31)...(31): Xaa = Arg, Lys or His with a COOH, CONH2 or a C-terminal blocking group
XXXXXFSDEXNTIXDXXAXXXFIXWLXXTKX

SEQ ID NO: 31 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXFSDEXNTIXDXXAXXXFIXWLXXTKXX

SEQ ID NO: 32 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXFSDEXNTIXDXXAXXXFIXWLXXTK

SEQ ID NO: 33 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (32)...(32): Xaa = Arg, Lys or His with a COOH, CONH2 or a C-terminal blocking group
XXXXXXFSDEXNTIXDXXAXXXFIXWLXXTKX

SEQ ID NO: 34 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha- aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXFSDEXNTIXDXXAXXXFIXWLXXTKXX

SEQ ID NO: 35 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
XXXXXXXFSDEXNTIXDXXAXXXFIXWLXXTK

SEQ ID NO: 36 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (33)...(33): Xaa = Arg, Lys or His with a COOH, CONH2 or a C-terminal blocking group
XXXXXXXFSDEXNTIXDXXAXXXFIXWLXXTKX

SEQ ID NO: 37 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXXFSDEXNTIXDXXAXXXFIXWLXXTKXX

SEQ ID NO: 38 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXFSDEXNTIXDXXAXXXFVQWLXXTK

SEQ ID NO: 39 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (31)...(31): Xaa = Arg, Lys or His with a COOH, CONH2 or a C-terminal blocking group
XXXXXFSDEXNTIXDXXAXXXFVQWLXXTKX

SEQ ID NO: 40 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXFSDEXNTIXDXXAXXXFVQWLXXTKXX

SEQ ID NO: 41 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXFSDEXNTIXDXXAXXXFVQWLXXTK

SEQ ID NO: 42 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (32)...(32): Xaa = Arg, Lys or His with a COOH, CONH2 or a C-terminal blocking group
XXXXXXFSDEXNTIXDXXAXXXFVQWLXXTKX

SEQ ID NO: 43 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXFSDEXNTIXDXXAXXXFVQWLXXTKXX

SEQ ID NO: 44 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
XXXXXXXFSDEXNTIXDXXAXXXFVQWLXXTK

SEQ ID NO: 45 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (33)...(33): Xaa = Arg, Lys or His with a COOH, CONH2 or a C-terminal blocking group
XXXXXXXFSDEXNTIXDXXAXXXFVQWLXXTKX

SEQ ID NO: 46 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXXFSDEXNTIXDXXAXXXFVQWLXXTKXX

SEQ ID NO: 47 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXFSDGXNTVXDXXAXXXFIXWLXXTK

SEQ ID NO: 48 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (31)...(31): Xaa = Arg, Lys or His with a COOH, CONH2 or a C-terminal blocking group
XXXXXFSDGXNTVXDXXAXXXFIXWLXXTKX

SEQ ID NO: 49 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXFSDGXNTVXDXXAXXXFIXWLXXTKXX

SEQ ID NO: 50 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXFSDGXNTVXDXXAXXXFIXWLXXTK

SEQ ID NO: 51 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (32)...(32): Xaa = Arg, Lys or His with a COOH, CONH2 or a C-terminal blocking group
XXXXXXFSDGXNTVXDXXAXXXFIXWLXXTKX

SEQ ID NO: 52 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXFSDGXNTVXDXXAXXXFIXWLXXTKXX

SEQ ID NO: 53 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
XXXXXXXFSDGXNTVXDXXAXXXFIXWLXXTK

SEQ ID NO: 54 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (33)...(33): Xaa = Arg, Lys or His with a COOH, CONH2 or a C-terminal blocking group
XXXXXXXFSDGXNTVXDXXAXXXFIXWLXXTKX

SEQ ID NO: 55 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXXFSDGXNTVXDXXAXXXFIXWLXXTKXX

SEQ ID NO: 56 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXFSDGXNTVXDXXAXXXFVQWLXXTK

SEQ ID NO: 57 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (31)...(31): Xaa = Arg, Lys or His with a COOH, CONH2 or a C-terminal blocking group
XXXXXFSDGXNTVXDXXAXXXFVQWLXXTKX

SEQ ID NO: 58 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXFSDGXNTVXDXXAXXXFVQWLXXTKXX

SEQ ID NO: 59 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXFSDGXNTVXDXXAXXXFVQWLXXTK

SEQ ID NO: 60 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (32)...(32): Xaa = Arg, Lys or His with a COOH, CONH2 or a C-terminal blocking group
XXXXXXFSDGXNTVXDXXAXXXFVQWLXXTKX

SEQ ID NO: 61 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXFSDGXNTVXDXXAXXXFVQWLXXTKXX

SEQ ID NO: 62 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
XXXXXXXFSDGXNTVXDXXAXXXFVQWLXXTK

SEQ ID NO: 63 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (33)...(33): Xaa = Arg, Lys or His with a COOH, CONH2 or a C-terminal blocking group
XXXXXXXFSDGXNTVXDXXAXXXFVQWLXXTKX

SEQ ID NO: 64 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXXFSDGXNTVXDXXAXXXFVQWLXXTKXX

SEQ ID NO: 65 - protein, 29 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
XXXXXFSDYSKYXDXXAXXXFIXWLXXTK

SEQ ID NO: 66 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (30)...(30): Xaa = Arg, Lys or His with a COOH, CONH2 or a C-terminal blocking group
XXXXXFSDYSKYXDXXAXXXFIXWLXXTKX

SEQ ID NO: 67 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (30)...(30): Xaa = Arg, Lys or His
  VARIANT (31)...(31): Xaa = Arg, Lys or His with a COOH, CONH2 or a C-terminal blocking group
XXXXXFSDYSKYXDXXAXXXFIXWLXXTKXX

SEQ ID NO: 68 - protein, 30 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXXFSDYSKYXDXXAXXXFIXWLXXTK

SEQ ID NO: 69 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (31)...(31): Xaa = Arg, Lys or His with a COOH, CONH2 or a C-terminal blocking group
XXXXXXFSDYSKYXDXXAXXXFIXWLXXTKX

SEQ ID NO: 70 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXXFSDYSKYXDXXAXXXFIXWLXXTKXX

SEQ ID NO: 71 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXXFSDYSKYXDXXAXXXFIXWLXXTK

SEQ ID NO: 72 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (32)...(32): Xaa = Arg, Lys or His with a COOH, CONH2 or a C-terminal blocking group
XXXXXXXFSDYSKYXDXXAXXXFIXWLXXTKX

SEQ ID NO: 73 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXXFSDYSKYXDXXAXXXFIXWLXXTKXX

SEQ ID NO: 74 - protein, 29 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
XXXXXFSDYSKYXDXXAXXXFVQWLXXTK

SEQ ID NO: 75 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (30)...(30): Xaa = Arg, Lys or His with a COOH, CONH2 or a C-terminal blocking group
XXXXXFSDYSKYXDXXAXXXFVQWLXXTKX

SEQ ID NO: 76 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (30)...(30): Xaa = Arg, Lys or His
  VARIANT (31)...(31): Xaa = Arg, Lys or His with a COOH, CONH2 or a C-terminal blocking group
XXXXXFSDYSKYXDXXAXXXFVQWLXXTKXX

SEQ ID NO: 77 - protein, 30 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXXFSDYSKYXDXXAXXXFVQWLXXTK

SEQ ID NO: 78 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (31)...(31): Xaa = Arg, Lys or His with a COOH, CONH2 or a C-terminal blocking group
XXXXXXFSDYSKYXDXXAXXXFVQWLXXTKX

SEQ ID NO: 79 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXXFSDYSKYXDXXAXXXFVQWLXXTKXX

SEQ ID NO: 80 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXXFSDYSKYXDXXAXXXFVQWLXXTK

SEQ ID NO: 81 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (32)...(32): Xaa = Arg, Lys or His with a COOH, CONH2 or a C-terminal blocking group
XXXXXXXFSDYSKYXDXXAXXXFVQWLXXTKX

SEQ ID NO: 82 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXXFSDYSKYXDXXAXXXFVQWLXXTKXX

SEQ ID NO: 83 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXFSDEXNTIXDXXAXXXFIXWLXXTKI

SEQ ID NO: 84 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (32)...(32): Xaa = Arg, Lys or His with a COOH, CONH2 or a C-terminal blocking group
XXXXXFSDEXNTIXDXXAXXXFIXWLXXTKIX

SEQ ID NO: 85 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXFSDEXNTIXDXXAXXXFIXWLXXTKIXX

SEQ ID NO: 86 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXFSDEXNTIXDXXAXXXFIXWLXXTKI

SEQ ID NO: 87 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (33)...(33): Xaa = Arg, Lys or His with a COOH, CONH2 or a C-terminal blocking group
XXXXXXFSDEXNTIXDXXAXXXFIXWLXXTKIX

SEQ ID NO: 88 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXFSDEXNTIXDXXAXXXFIXWLXXTKIXX

SEQ ID NO: 89 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
XXXXXXXFSDEXNTIXDXXAXXXFIXWLXXTKI

SEQ ID NO: 90 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (34)...(34): Xaa = Arg, Lys or His with a COOH, CONH2 or a C-terminal blocking group
XXXXXXXFSDEXNTIXDXXAXXXFIXWLXXTKIX

SEQ ID NO: 91 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXXFSDEXNTIXDXXAXXXFIXWLXXTKIXX

SEQ ID NO: 92 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXFSDEXNTIXDXXAXXXFVQWLXXTKI

SEQ ID NO: 93 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (32)...(32): Xaa = Arg, Lys or His with a COOH, CONH2 or a C-terminal blocking group
XXXXXFSDEXNTIXDXXAXXXFVQWLXXTKIX

SEQ ID NO: 94 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXFSDEXNTIXDXXAXXXFVQWLXXTKIXX

SEQ ID NO: 95 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXFSDEXNTIXDXXAXXXFVQWLXXTKI

SEQ ID NO: 96 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (33)...(33): Xaa = Arg, Lys or His with a COOH, CONH2 or a C-terminal blocking group
XXXXXXFSDEXNTIXDXXAXXXFVQWLXXTKIX

SEQ ID NO: 97 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXFSDEXNTIXDXXAXXXFVQWLXXTKIXX

SEQ ID NO: 98 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
XXXXXXXFSDEXNTIXDXXAXXXFVQWLXXTKI

SEQ ID NO: 99 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (34)...(34): Xaa = Arg, Lys or His with a COOH, CONH2 or a C-terminal blocking group
XXXXXXXFSDEXNTIXDXXAXXXFVQWLXXTKIX

SEQ ID NO: 100 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXXFSDEXNTIXDXXAXXXFVQWLXXTKIXX

SEQ ID NO: 101 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXFSDGXNTVXDXXAXXXFIXWLXXTKI

SEQ ID NO: 102 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (32)...(32): Xaa = Arg, Lys or His with a COOH, CONH2 or a C-terminal blocking group
XXXXXFSDGXNTVXDXXAXXXFIXWLXXTKIX

SEQ ID NO: 103 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXFSDGXNTVXDXXAXXXFIXWLXXTKIXX

SEQ ID NO: 104 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXFSDGXNTVXDXXAXXXFIXWLXXTKI

SEQ ID NO: 105 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (33)...(33): Xaa = Arg, Lys or His with a COOH, CONH2 or a C-terminal blocking group
XXXXXXFSDGXNTVXDXXAXXXFIXWLXXTKIX

SEQ ID NO: 106 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXFSDGXNTVXDXXAXXXFIXWLXXTKIXX

SEQ ID NO: 107 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
XXXXXXXFSDGXNTVXDXXAXXXFIXWLXXTKI

SEQ ID NO: 108 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (34)...(34): Xaa = Arg, Lys or His with a COOH, CONH2 or a C-terminal blocking group
XXXXXXXFSDGXNTVXDXXAXXXFIXWLXXTKIX

SEQ ID NO: 109 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXXFSDGXNTVXDXXAXXXFIXWLXXTKIXX

SEQ ID NO: 110 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXFSDGXNTVXDXXAXXXFVQWLXXTKI

SEQ ID NO: 111 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (32)...(32): Xaa = Arg, Lys or His with a COOH, CONH2 or a C-terminal blocking group
XXXXXFSDGXNTVXDXXAXXXFVQWLXXTKIX

SEQ ID NO: 112 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXFSDGXNTVXDXXAXXXFVQWLXXTKIXX

SEQ ID NO: 113 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXFSDGXNTVXDXXAXXXFVQWLXXTKI

SEQ ID NO: 114 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (33)...(33): Xaa = Arg, Lys or His with a COOH, CONH2 or a C-terminal blocking group
XXXXXXFSDGXNTVXDXXAXXXFVQWLXXTKIX

SEQ ID NO: 115 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXFSDGXNTVXDXXAXXXFVQWLXXTKIXX

SEQ ID NO: 116 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
XXXXXXXFSDGXNTVXDXXAXXXFVQWLXXTKI

SEQ ID NO: 117 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (34)...(34): Xaa = Arg, Lys or His with a COOH, CONH2 or a C-terminal blocking group
XXXXXXXFSDGXNTVXDXXAXXXFVQWLXXTKIX

SEQ ID NO: 118 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXXFSDGXNTVXDXXAXXXFVQWLXXTKIXX

SEQ ID NO: 119 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
XXXXXFSDYSKYXDXXAXXXFIXWLXXTKI

SEQ ID NO: 120 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (31)...(31): Xaa = Arg, Lys or His with a COOH, CONH2 or a C-terminal blocking group
XXXXXFSDYSKYXDXXAXXXFIXWLXXTKIX

SEQ ID NO: 121 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXFSDYSKYXDXXAXXXFIXWLXXTKIXX

SEQ ID NO: 122 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXXFSDYSKYXDXXAXXXFIXWLXXTKI

SEQ ID NO: 123 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (32)...(32): Xaa = Arg, Lys or His with a COOH, CONH2 or a C-terminal blocking group
XXXXXXFSDYSKYXDXXAXXXFIXWLXXTKIX

SEQ ID NO: 124 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXFSDYSKYXDXXAXXXFIXWLXXTKIXX

SEQ ID NO: 125 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXXFSDYSKYXDXXAXXXFIXWLXXTKI

SEQ ID NO: 126 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (33)...(33): Xaa = Arg, Lys or His with a COOH, CONH2 or a C-terminal blocking group
XXXXXXXFSDYSKYXDXXAXXXFIXWLXXTKIX

SEQ ID NO: 127 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXXFSDYSKYXDXXAXXXFIXWLXXTKIXX

SEQ ID NO: 128 - protein, 30 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
XXXXXFSDYSKYXDXXAXXXFVQWLXXTKI

SEQ ID NO: 129 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (31)...(31): Xaa = Arg, Lys or His with a COOH, CONH2 or a C-terminal blocking group
XXXXXFSDYSKYXDXXAXXXFVQWLXXTKIX

SEQ ID NO: 130 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (31)...(31): Xaa = Arg, Lys or His
  VARIANT (32)...(32): Xaa = Arg, Lys or His with a COOH, CONH2 or a C-terminal blocking group
XXXXXFSDYSKYXDXXAXXXFVQWLXXTKIXX

SEQ ID NO: 131 - protein, 31 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXXFSDYSKYXDXXAXXXFVQWLXXTKI

SEQ ID NO: 132 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (32)...(32): Xaa = Arg, Lys or His with a COOH, CONH2 or a C-terminal blocking group
XXXXXXFSDYSKYXDXXAXXXFVQWLXXTKIX

SEQ ID NO: 133 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXXFSDYSKYXDXXAXXXFVQWLXXTKIXX

SEQ ID NO: 134 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXXFSDYSKYXDXXAXXXFVQWLXXTKI

SEQ ID NO: 135 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (33)...(33): Xaa = Arg, Lys or His with a COOH, CONH2 or a C-terminal blocking group
XXXXXXXFSDYSKYXDXXAXXXFVQWLXXTKIX

SEQ ID NO: 136 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXXFSDYSKYXDXXAXXXFVQWLXXTKIXX

SEQ ID NO: 137 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXFSDEXNTIXDXXAXXXFIXWLXXTKIT

SEQ ID NO: 138 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Arg, Lys or His with a COOH, CONH2 or a C-terminal blocking group
XXXXXFSDEXNTIXDXXAXXXFIXWLXXTKITX

SEQ ID NO: 139 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXFSDEXNTIXDXXAXXXFIXWLXXTKITXX

SEQ ID NO: 140 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXFSDEXNTIXDXXAXXXFIXWLXXTKIT

SEQ ID NO: 141 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Arg, Lys or His with a COOH, CONH2 or a C-terminal blocking group
XXXXXXFSDEXNTIXDXXAXXXFIXWLXXTKITX

SEQ ID NO: 142 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXFSDEXNTIXDXXAXXXFIXWLXXTKITXX

SEQ ID NO: 143 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
XXXXXXXFSDEXNTIXDXXAXXXFIXWLXXTKIT

SEQ ID NO: 144 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Arg, Lys or His with a COOH, CONH2 or a C-terminal blocking group
XXXXXXXFSDEXNTIXDXXAXXXFIXWLXXTKITX

SEQ ID NO: 145 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Arg, Lys or His
  VARIANT (36)...(36): Xaa = Arg, Lys or His with a COOH, CONH2 or a C-terminal blocking group
XXXXXXXFSDEXNTIXDXXAXXXFIXWLXXTKITXX

SEQ ID NO: 146 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXFSDEXNTIXDXXAXXXFVQWLXXTKIT

SEQ ID NO: 147 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Arg, Lys or His with a COOH, CONH2 or a C-terminal blocking group
XXXXXFSDEXNTIXDXXAXXXFVQWLXXTKITX

SEQ ID NO: 148 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXFSDEXNTIXDXXAXXXFVQWLXXTKITXX

SEQ ID NO: 149 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXFSDEXNTIXDXXAXXXFVQWLXXTKIT

SEQ ID NO: 150 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Arg, Lys or His with a COOH, CONH2 or a C-terminal blocking group
XXXXXXFSDEXNTIXDXXAXXXFVQWLXXTKITX

SEQ ID NO: 151 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXFSDEXNTIXDXXAXXXFVQWLXXTKITXX

SEQ ID NO: 152 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
XXXXXXXFSDEXNTIXDXXAXXXFVQWLXXTKIT

SEQ ID NO: 153 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Arg, Lys or His with a COOH, CONH2 or a C-terminal blocking group
XXXXXXXFSDEXNTIXDXXAXXXFVQWLXXTKITX

SEQ ID NO: 154 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Arg, Lys or His
  VARIANT (36)...(36): Xaa = Arg, Lys or His with a COOH, CONH2 or a C-terminal blocking group
XXXXXXXFSDEXNTIXDXXAXXXFVQWLXXTKITXX

SEQ ID NO: 155 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXFSDGXNTVXDXXAXXXFIXWLXXTKIT

SEQ ID NO: 156 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Arg, Lys or His with a COOH, CONH2 or a C-terminal blocking group
XXXXXFSDGXNTVXDXXAXXXFIXWLXXTKITX

SEQ ID NO: 157 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXFSDGXNTVXDXXAXXXFIXWLXXTKITXX

SEQ ID NO: 158 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXFSDGXNTVXDXXAXXXFIXWLXXTKIT

SEQ ID NO: 159 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Arg, Lys or His with a COOH, CONH2 or a C-terminal blocking group
XXXXXXFSDGXNTVXDXXAXXXFIXWLXXTKITX

SEQ ID NO: 160 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXFSDGXNTVXDXXAXXXFIXWLXXTKITXX

SEQ ID NO: 161 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
XXXXXXXFSDGXNTVXDXXAXXXFIXWLXXTKIT

SEQ ID NO: 162 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Arg, Lys or His with a COOH, CONH2 or a C-terminal blocking group
XXXXXXXFSDGXNTVXDXXAXXXFIXWLXXTKITX

SEQ ID NO: 163 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Arg, Lys or His
  VARIANT (36)...(36): Xaa = Arg, Lys or His with a COOH, CONH2 or a C-terminal blocking group
XXXXXXXFSDGXNTVXDXXAXXXFIXWLXXTKITXX

SEQ ID NO: 164 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXFSDGXNTVXDXXAXXXFVQWLXXTKIT

SEQ ID NO: 165 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Arg, Lys or His with a COOH, CONH2 or a C-terminal blocking group
XXXXXFSDGXNTVXDXXAXXXFVQWLXXTKITX

SEQ ID NO: 166 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXFSDGXNTVXDXXAXXXFVQWLXXTKITXX

SEQ ID NO: 167 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXFSDGXNTVXDXXAXXXFVQWLXXTKIT

SEQ ID NO: 168 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Arg, Lys or His with a COOH, CONH2 or a C-terminal blocking group
XXXXXXFSDGXNTVXDXXAXXXFVQWLXXTKITX

SEQ ID NO: 169 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXFSDGXNTVXDXXAXXXFVQWLXXTKITXX

SEQ ID NO: 170 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
XXXXXXXFSDGXNTVXDXXAXXXFVQWLXXTKIT

SEQ ID NO: 171 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Arg, Lys or His with a COOH, CONH2 or a C-terminal blocking group
XXXXXXXFSDGXNTVXDXXAXXXFVQWLXXTKITX

SEQ ID NO: 172 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Arg, Lys or His
  VARIANT (36)...(36): Xaa = Arg, Lys or His with a COOH, CONH2 or a C-terminal blocking group
XXXXXXXFSDGXNTVXDXXAXXXFVQWLXXTKITXX

SEQ ID NO: 173 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
XXXXXFSDYSKYXDXXAXXXFIXWLXXTKIT

SEQ ID NO: 174 - protein, 32 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (32)...(32): Xaa = Arg, Lys or His with a COOH, CONH2 or a C-terminal blocking group
XXXXXFSDYSKYXDXXAXXXFIXWLXXTKITX

SEQ ID NO: 175 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXFSDYSKYXDXXAXXXFIXWLXXTKITXX

SEQ ID NO: 176 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
XXXXXXFSDYSKYXDXXAXXXFIXWLXXTKIT

SEQ ID NO: 177 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Arg, Lys or His with a COOH, CONH2 or a C-terminal blocking group
XXXXXXFSDYSKYXDXXAXXXFIXWLXXTKITX

SEQ ID NO: 178 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXFSDYSKYXDXXAXXXFIXWLXXTKITXX

SEQ ID NO: 179 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
XXXXXXXFSDYSKYXDXXAXXXFIXWLXXTKIT

SEQ ID NO: 180 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Arg, Lys or His with a COOH, CONH2 or a C-terminal blocking group
XXXXXXXFSDYSKYXDXXAXXXFIXWLXXTKITX

SEQ ID NO: 181 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXXFSDYSKYXDXXAXXXFIXWLXXTKITXX

SEQ ID NO: 182 - protein, 31 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
XXXXXFSDYSKYXDXXAXXXFVQWLXXTKIT

SEQ ID NO: 183 - protein, 32 aa, Artificial Sequence; identical to SEQ ID NO: 2
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (32)...(32): Xaa = Arg, Lys or His with a COOH, CONH2 or a C-terminal blocking group

SEQ ID NO: 184 - protein, 33 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (32)...(32): Xaa = Arg, Lys or His
  VARIANT (33)...(33): Xaa = Arg, Lys or His with a COOH, CONH2 or a C-terminal blocking group
XXXXXFSDYSKYXDXXAXXXFVQWLXXTKITXX

SEQ ID NO: 185 - protein, 32 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
XXXXXXFSDYSKYXDXXAXXXFVQWLXXTKIT

SEQ ID NO: 186 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Arg, Lys or His with a COOH, CONH2 or a C-terminal blocking group
XXXXXXFSDYSKYXDXXAXXXFVQWLXXTKITX

SEQ ID NO: 187 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Arg, Lys or His
  VARIANT (34)...(34): Xaa = Arg, Lys or His with a COOH, CONH2 or a C-terminal blocking group
XXXXXXFSDYSKYXDXXAXXXFVQWLXXTKITXX

SEQ ID NO: 188 - protein, 33 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
XXXXXXXFSDYSKYXDXXAXXXFVQWLXXTKIT

SEQ ID NO: 189 - protein, 34 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Arg, Lys or His with a COOH, CONH2 or a C-terminal blocking group
XXXXXXXFSDYSKYXDXXAXXXFVQWLXXTKITX

SEQ ID NO: 190 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Arg, Lys or His
  VARIANT (35)...(35): Xaa = Arg, Lys or His with a COOH, CONH2 or a C-terminal blocking group
XXXXXXXFSDYSKYXDXXAXXXFVQWLXXTKITXX

SEQ ID NO: 191 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group
XXXXXFSDEXNTIXDXXAXXXFIIXWLXXTKITX

SEQ ID NO: 192 - protein, 35 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group
XXXXXFSDEXNTIXDXXAXXXFIIXWLXXTKITXX

SEQ ID NO: 193 - protein, 36 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXFSDEXNTIXDXXAXXXFIIXWLXXTKITXXX

SEQ ID NO: 194 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Asp or Asn, with a COOH, CONH2 or a C-terminal blocking group
XXXXXXFSDEXNTIXDXXAXXXFIIXWLXXTKITX

SEQ ID NO: 195 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His with a COOH, CONH2 or a C-terminal blocking group
XXXXXXFSDEXNTIXDXXAXXXFIIXWLXXTKITXX

SEQ ID NO: 196 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His
  VARIANT (37)...(37): Xaa = Arg, Lys or His with a COOH, CONH2 or a C-terminal blocking group
XXXXXXFSDEXNTIXDXXAXXXFIIXWLXXTKITXXX

SEQ ID NO: 197 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (27)...(27): Xaa = Asn or Ala
  VARIANT (30)...(30): Xaa = Ile or Leu
  VARIANT (31)...(31): Xaa = Gln or His
  VARIANT (36)...(36): Xaa = Asp or Asn, with a COOH, CONH2 or a C-terminal blocking group
XXXXXXXFSDEXNTIXDXXAXXXFIIXWLXXTKITX

SEQ ID NO: 198 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (27)...(27): Xaa = Asn or Ala
  VARIANT (30)...(30): Xaa = Ile or Leu
  VARIANT (31)...(31): Xaa = Gln or His
  VARIANT (36)...(36): Xaa = Asp or Asn
  VARIANT (37)...(37): Xaa = Arg, Lys or His with a COOH, CONH2 or a C-terminal blocking group
XXXXXXXFSDEXNTIXDXXAXXXFIIXWLXXTKITXX

SEQ ID NO: 199 - protein, 38 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (27)...(27): Xaa = Asn or Ala
  VARIANT (30)...(30): Xaa = Ile or Leu
  VARIANT (31)...(31): Xaa = Gln or His
  VARIANT (36)...(36): Xaa = Asp or Asn
  VARIANT (37)...(37): Xaa = Arg, Lys or His
  VARIANT (38)...(38): Xaa = Arg, Lys or His with a COOH, CONH2 or a C-terminal blocking group
XXXXXXXFSDEXNTIXDXXAXXXFIIXWLXXTKITXXX

SEQ ID NO: 200 - protein, 33 aa, Artificial Sequence; identical to SEQ ID NO: 147
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn, with a COOH, CONH2 or a C-terminal blocking group

SEQ ID NO: 201 - protein, 34 aa, Artificial Sequence; identical to SEQ ID NO: 148
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His with a COOH, CONH2 or a C-terminal blocking group

SEQ ID NO: 202 - protein, 35 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His
  VARIANT (35)...(35): Xaa = Arg, Lys or His with a COOH, CONH2 or a C-terminal blocking group
XXXXXFSDEXNTIXDXXAXXXFVQWLXXTKITXXX

SEQ ID NO: 203 - protein, 34 aa, Artificial Sequence; identical to SEQ ID NO: 150
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group

SEQ ID NO: 204 - protein, 35 aa, Artificial Sequence; identical to SEQ ID NO: 151
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group

SEQ ID NO: 205 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXXFSDEXNTIXDXXAXXXFVQWLXXTKITXXX

SEQ ID NO: 206 - protein, 35 aa, Artificial Sequence; identical to SEQ ID NO: 153
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Asp or Asn, with a COOH, CONH2 or a C-terminal blocking group

SEQ ID NO: 207 - protein, 36 aa, Artificial Sequence; identical to SEQ ID NO: 154
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His with a COOH, CONH2 or a C-terminal blocking group

SEQ ID NO: 208 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His
  VARIANT (37)...(37): Xaa = Arg, Lys or His with a COOH, CONH2 or a C-terminal blocking group
XXXXXXXFSDEXNTIXDXXAXXXFVQWLXXTKITXXX

SEQ ID NO: 209 - protein, 33 aa, Artificial Sequence; identical to SEQ ID NO: 156
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Asp or Asn, with a COOH, CONH2 or a C-terminal blocking group

SEQ ID NO: 210 - protein, 34 aa, Artificial Sequence; identical to SEQ ID NO: 157
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His with a COOH, CONH2 or a C-terminal blocking group

SEQ ID NO: 211 - protein, 35 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His with a COOH, CONH2 or a C-terminal blocking group
  VARIANT (35)...(35): Xaa = Arg, Lys or His with a COOH, CONH2 or a C-terminal blocking group
XXXXXFSDGXNTVXDXXAXXXFIXWLXXTKITXXX

SEQ ID NO: 212 - protein, 34 aa, Artificial Sequence; identical to SEQ ID NO: 159
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group

SEQ ID NO: 213 - protein, 35 aa, Artificial Sequence; identical to SEQ ID NO: 160
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr,
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group

SEQ ID NO: 214 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXXFSDGXNTVXDXXAXXXFIXWLXXTKITXXX

SEQ ID NO: 215 - protein, 35 aa, Artificial Sequence; identical to SEQ ID NO: 162
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Asp or Asn, with a COOH, CONH2 or a C-terminal blocking group

SEQ ID NO: 216 - protein, 36 aa, Artificial Sequence; identical to SEQ ID NO: 163
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His with a COOH, CONH2 or a C-terminal blocking group

SEQ ID NO: 217 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (26)...(26): Xaa = Asn or Ala
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His
  VARIANT (37)...(37): Xaa = Arg, Lys or His with a COOH, CONH2 or a C-terminal blocking group
XXXXXXXFSDGXNTVXDXXAXXXFIXWLXXTKITXXX

SEQ ID NO: 218 - protein, 33 aa, Artificial Sequence; identical to SEQ ID NO: 165
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn, with a COOH, CONH2 or a C-terminal blocking group

SEQ ID NO: 219 - protein, 34 aa, Artificial Sequence; identical to SEQ ID NO: 166
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His with a COOH, CONH2 or a C-terminal blocking group

SEQ ID NO: 220 - protein, 35 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His
  VARIANT (35)...(35): Xaa = Arg, Lys or His with a COOH, CONH2 or a C-terminal blocking group
XXXXXFSDGXNTVXDXXAXXXFVQWLXXTKITXXX

SEQ ID NO: 221 - protein, 34 aa, Artificial Sequence; identical to SEQ ID NO: 168
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group

SEQ ID NO: 222 - protein, 35 aa, Artificial Sequence; identical to SEQ ID NO: 169
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group

SEQ ID NO: 223 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXXFSDGXNTVXDXXAXXXFVQWLXXTKITXXX

SEQ ID NO: 224 - protein, 35 aa, Artificial Sequence; identical to SEQ ID NO: 171
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Asp or Asn, with a COOH, CONH2 or a C-terminal blocking group

SEQ ID NO: 225 - protein, 36 aa, Artificial Sequence; identical to SEQ ID NO: 172
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His with a COOH, CONH2 or a C-terminal blocking group

SEQ ID NO: 226 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His
  VARIANT (37)...(37): Xaa = Arg, Lys or His with a COOH, CONH2 or a C-terminal blocking group
XXXXXXXFSDGXNTVXDXXAXXXFVQWLXXTKITXXX

SEQ ID NO: 227 - protein, 32 aa, Artificial Sequence; identical to SEQ ID NO: 174
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (32)...(32): Xaa = Asp or Asn, with a COOH, CONH2 or a C-terminal blocking group

SEQ ID NO: 228 - protein, 33 aa, Artificial Sequence; identical to SEQ ID NO: 175
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (32)...(32): Xaa = Asp or Asn
  VARIANT (33)...(33): Xaa = Arg, Lys or His with a COOH, CONH2 or a C-terminal blocking group

SEQ ID NO: 229 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (23)...(23): Xaa = Asn or Ala
  VARIANT (26)...(26): Xaa = Ile or Leu
  VARIANT (27)...(27): Xaa = Gln or His
  VARIANT (32)...(32): Xaa = Asp or Asn
  VARIANT (33)...(33): Xaa = Arg, Lys or His
  VARIANT (34)...(34): Xaa = Arg, Lys or His with a COOH, CONH2 or a C-terminal blocking group
XXXXXFSDYSKYXDXXAXXXFIXWLXXTKITXXX

SEQ ID NO: 230 - protein, 33 aa, Artificial Sequence; identical to SEQ ID NO: 177
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Asp or Asn, with a COOH, CONH2 or a C-terminal blocking group

SEQ ID NO: 231 - protein, 34 aa, Artificial Sequence; identical to SEQ ID NO: 178
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His with a COOH, CONH2 or a C-terminal blocking group

SEQ ID NO: 232 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (24)...(24): Xaa = Asn or Ala
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His
  VARIANT (35)...(35): Xaa = Arg, Lys or His with a COOH, CONH2 or a C-terminal blocking group
XXXXXXFSDYSKYXDXXAXXXFIXWLXXTKITXXX

SEQ ID NO: 233 - protein, 34 aa, Artificial Sequence; identical to SEQ ID NO: 180
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group

SEQ ID NO: 234 - protein, 35 aa, Artificial Sequence; identical to SEQ ID NO: 181
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group

SEQ ID NO: 235 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (25)...(25): Xaa = Asn or Ala
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXXXFSDYSKYXDXXAXXXFIXWLXXTKITXXX

SEQ ID NO: 236 - protein, 33 aa, Artificial Sequence; identical to SEQ ID NO: 184
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (32)...(32): Xaa = Asp or Asn
  VARIANT (33)...(33): Xaa = Arg, Lys or His with a COOH, CONH2 or a C-terminal blocking group

SEQ ID NO: 237 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (13)...(13): Xaa = Leu or Lys
  VARIANT (15)...(15): Xaa = Asn, Lys or Ala
  VARIANT (16)...(16): Xaa = Leu or Lys
  VARIANT (18)...(18): Xaa = Ala or Thr
  VARIANT (19)...(19): Xaa = Arg, Lys, His or Ala
  VARIANT (20)...(20): Xaa = Asp or Lys
  VARIANT (26)...(26): Xaa = Ile or Leu
  VARIANT (27)...(27): Xaa = Gln or His
  VARIANT (32)...(32): Xaa = Asp or Asn
  VARIANT (33)...(33): Xaa = Arg, Lys or His
  VARIANT (34)...(34): Xaa = Arg, Lys or His with a COOH, CONH2 or a C-terminal blocking group
XXXXXFSDYSKYXDXXAXXXFVQWLXXTKITXXX

SEQ ID NO: 238 - protein, 33 aa, Artificial Sequence; identical to SEQ ID NO: 186
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn, with a COOH, CONH2 or a C-terminal blocking group

SEQ ID NO: 239 - protein, 34 aa, Artificial Sequence; identical to SEQ ID NO: 187
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His with a COOH, CONH2 or a C-terminal blocking group

SEQ ID NO: 240 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (27)...(27): Xaa = Ile or Leu
  VARIANT (28)...(28): Xaa = Gln or His
  VARIANT (33)...(33): Xaa = Asp or Asn
  VARIANT (34)...(34): Xaa = Arg, Lys or His
  VARIANT (35)...(35): Xaa = Arg, Lys or His with a COOH, CONH2 or a C-terminal blocking group
XXXXXXFSDYSKYXDXXAXXXFVQWLXXTKITXXX

SEQ ID NO: 241 - protein, 34 aa, Artificial Sequence; identical to SEQ ID NO: 189
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group when Xaa in position 28 is absent

SEQ ID NO: 242 - protein, 35 aa, Artificial Sequence; identical to SEQ ID NO: 190
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group

SEQ ID NO: 243 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXXXFSDYSKYXDXXAXXXFVQWLXXTKITXXX

SEQ ID NO: 244 - protein, 34 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (28)...(28): Xaa = Ile or Leu
  VARIANT (29)...(29): Xaa = Gln or His
  VARIANT (34)...(34): Xaa = Asp or Asn, with a COOH, CONH2 or a C-terminal blocking group
XXXXXFSDEXNTIXDXXAXXXFIVQWLXXTKITX

SEQ ID NO: 245 - protein, 35 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His with a COOH, CONH2 or a C-terminal blocking group
XXXXXFSDEXNTIXDXXAXXXFIVQWLXXTKITXX

SEQ ID NO: 246 - protein, 36 aa, Artificial Sequence
  intestinotrophic analog of GLP-2
  VARIANT (1)...(1): Xaa = His or Tyr, with an amino terminal group or an amino terminal blocking group
  VARIANT (2)...(2): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (3)...(3): Xaa = Asp, Glu, Pro or Hpro (hydroxyproline); or Xaa-Xaa in positions 2 and 3 taken together are Xaa(psi)(CH(OH)CH2)Xaa; Xaa(psi)(CH2NH2)Xaa or Xaa(psi)(CHCH)Xaa
  VARIANT (4)...(4): Xaa = Gly or Ala
  VARIANT (5)...(5): Xaa = Ser or Ala
  VARIANT (10)...(10): Xaa = Met, Leu, Ile or an oxidatively stable Met-replacement amino acid
  VARIANT (14)...(14): Xaa = Leu or Lys
  VARIANT (16)...(16): Xaa = Asn, Lys or Ala
  VARIANT (17)...(17): Xaa = Leu or Lys
  VARIANT (19)...(19): Xaa = Ala or Thr
  VARIANT (20)...(20): Xaa = Arg, Lys, His or Ala
  VARIANT (21)...(21): Xaa = Asp or Lys
  VARIANT (28)...(28): Xaa = Ile or Leu
  VARIANT (29)...(29): Xaa = Gln or His
  VARIANT (34)...(34): Xaa = Asp or Asn
  VARIANT (35)...(35): Xaa = Arg, Lys or His
  VARIANT (36)...(36): Xaa = Arg, Lys or His with a COOH, CONH2 or a C-terminal blocking group
XXXXXFSDEXNTIXDXXAXXXFIVQWLXXTKITXXX

SEQ ID NO: 247 - protein, 35 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (29)...(29): Xaa = Ile or Leu
  VARIANT (30)...(30): Xaa = Gln or His
  VARIANT (35)...(35): Xaa = Asp or Asn, with a COOH, CONH2 or a C-terminal blocking group
XXXXXXFSDEXNTIXDXXAXXXFIVQWLXXTKITX

SEQ ID NO: 248 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His with a COOH, CONH2 or a C-terminal blocking group
XXXXXXFSDEXNTIXDXXAXXXFIVQWLXXTKITXX

SEQ ID NO: 249 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = His or Tyr
  VARIANT (3)...(3): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (4)...(4): Xaa = Asp, Glu, Pro or Hpro (hydroxyproline); or Xaa-Xaa in positions 3 and 4 taken together are Xaa(psi)(CH(OH)CH2)Xaa; Xaa(psi)(CH2NH2)Xaa or Xaa(psi)(CHCH)Xaa
  VARIANT (5)...(5): Xaa = Gly or Ala
  VARIANT (6)...(6): Xaa = Ser or Ala
  VARIANT (11)...(11): Xaa = Met, Leu, Ile or an oxidatively stable Met-replacement amino acid
  VARIANT (15)...(15): Xaa = Leu or Lys
  VARIANT (17)...(17): Xaa = Asn, Lys or Ala
  VARIANT (18)...(18): Xaa = Leu or Lys
  VARIANT (20)...(20): Xaa = Ala or Thr
  VARIANT (21)...(21): Xaa = Arg, Lys, His or Ala
  VARIANT (22)...(22): Xaa = Asp or Lys
  VARIANT (29)...(29): Xaa = Ile or Leu
  VARIANT (30)...(30): Xaa = Gln or His
  VARIANT (35)...(35): Xaa = Asp or Asn
  VARIANT (36)...(36): Xaa = Arg, Lys or His
  VARIANT (37)...(37): Xaa = Arg, Lys or His with a COOH, CONH2 or a C-terminal blocking group
XXXXXXFSDEXNTIXDXXAXXXFIVQWLXXTKITXXX

SEQ ID NO: 250 - protein, 36 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (30)...(30): Xaa = Ile or Leu
  VARIANT (31)...(31): Xaa = Gln or His
  VARIANT (36)...(36): Xaa = Asp or Asn, with a COOH, CONH2 or a C-terminal blocking group
XXXXXXXFSDEXNTIXDXXAXXXFIVQWLXXTKITX

SEQ ID NO: 251 - protein, 37 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (30)...(30): Xaa = Ile or Leu
  VARIANT (31)...(31): Xaa = Gln or His
  VARIANT (36)...(36): Xaa = Asp or Asn
  VARIANT (37)...(37): Xaa = Arg, Lys or His with a COOH, CONH2 or a C-terminal blocking group
XXXXXXXFSDEXNTIXDXXAXXXFIVQWLXXTKITXX

SEQ ID NO: 252 - protein, 38 aa, Artificial Sequence
  intestinotrophic analog of GLP-2
  VARIANT (1)...(1): Xaa = Arg, Lys or His, with an amino terminal group or an amino terminal blocking group
  VARIANT (2)...(2): Xaa = Arg, Lys or His
  VARIANT (3)...(3): Xaa = His or Tyr
  VARIANT (4)...(4): Xaa = is Ala, Gly, D-Ala, Pro, Ile, Nva (Norvaline), alpha -aminobutyric acid, or an Ala-replacement amino acid conferring on said analog resistance to DPP-IV enzyme
  VARIANT (5)...(5): Xaa = Asp, Glu, Pro or Hpro (hydroxyproline); or Xaa-Xaa in positions 4 and 5 taken together are Xaa(psi)(CH(OH)CH2)Xaa; Xaa(psi)(CH2NH2)Xaa or Xaa(psi)(CHCH)Xaa
  VARIANT (6)...(6): Xaa = Gly or Ala
  VARIANT (7)...(7): Xaa = Ser or Ala
  VARIANT (12)...(12): Xaa = Met, Leu, Ile or an oxidatively stable Met-replacement amino acid
  VARIANT (16)...(16): Xaa = Leu or Lys
  VARIANT (18)...(18): Xaa = Asn, Lys or Ala
  VARIANT (19)...(19): Xaa = Leu or Lys
  VARIANT (21)...(21): Xaa = Ala or Thr
  VARIANT (22)...(22): Xaa = Arg, Lys, His or Ala
  VARIANT (23)...(23): Xaa = Asp or Lys
  VARIANT (30)...(30): Xaa = Ile or Leu
  VARIANT (31)...(31): Xaa = Gln or His
  VARIANT (36)...(36): Xaa = Asp or Asn
  VARIANT (37)...(37): Xaa = Arg, Lys or His
  VARIANT (38)...(38): Xaa = Arg, Lys or His with a COOH, CONH2 or a C-terminal blocking group
XXXXXXXFSDEXNTIXDXXAXXXFIVQWLXXTKITXXX

SEQ ID NO: 253 - protein, 5 aa, Artificial Sequence
  Peptide segment within intestinotrophic analog of GLP-2
  VARIANT (2)..(2): Xaa = Met, Leu, Ile or an Oxidatively stable Met-replacement amino acid
EXNTI

SEQ ID NO: 254 - protein, 5 aa, Artificial Sequence
  Peptide segment within intestinotrophic analog of GLP-2
  VARIANT (2)..(2): Xaa = Met, Leu, Ile or an oxidatively stable Met-replacement amino acid
GXNTV

SEQ ID NO: 255 - protein, 4 aa, Artificial Sequence
  Peptide segment within intestinotrophic analog of GLP-2
YSKY

SEQ ID NO: 256 - protein, 35 aa, Artificial Sequence
  Intestinotrophic analog of GLP-2
  VARIANT (1)..(1): Xaa is His with an amino terminal group or N-terminal blocking group
  VARIANT (14)..(14): Xaa is Leu or Lys
  VARIANT (16)..(16): Xaa is Asn or Lys
  VARIANT (17)..(17): Xaa is Leu or Lys
  VARIANT (21)..(21): Xaa is Asp or Lys
  VARIANT (34)..(34): Xaa is Arg, Lys or His
  VARIANT (35)..(35): Xaa is Arg with CONH2, Lys with CONH2 or His with CONH2
XGDGSFSDEMNTIXDXXAARXFINWLIQTKITDXX

SEQ ID NO: 257 - protein, 34 aa, Artificial Sequence
  Intestinotrophic analog of GLP-2
  VARIANT (1)..(1): Xaa = His with an amino terminal group or N-terminal blocking group
  VARIANT (14)..(14): Xaa = Leu or Lys
  VARIANT (16)..(16): Xaa = Asn or Lys
  VARIANT (17)..(17): Xaa = Leu or Lys
  VARIANT (21)..(21): Xaa = Asp or Lys
  VARIANT (34)..(34): Xaa = Arg with CONH2, Lys with CONH2, or His with CONH2
XGDGSFSDEMNTIXDXXAARXFINWLIQTKITDX

SEQ ID NO: 258 - protein, 33 aa, Artificial Sequence
  Intestinotrophic analog of GLP-2
  VARIANT (1)..(1): Xaa = His with an amino terminal group or N-terminal blocking
  VARIANT (14)..(14): Xaa = Leu or Lys
  VARIANT (16)..(16): Xaa = Asn or Lys
  VARIANT (17)..(17): Xaa = Leu or Lys
  VARIANT (21)..(21): Xaa = Asp or Lys
  VARIANT (33)..(33): Xaa = Asp with CONH2
XGDGSFSDEMNTIXDXXAARXFINWLIQTKITX

What is claimed is:

1. A gastrointestinal tissue growth promoter derivative comprising:
   a GLP-2 peptide having gastrointestinal tissue growth promoting activity; and
   a single maleimide or a maleimido-containing group, wherein the maleimide or maleimido-containing group is coupled, optionally via a linker, to the GLP-2 peptide at a His or Lys residue,
   wherein the GLP-2 peptide is of the sequence:
   $R_1$-$(Y_1)_m$-$X_1$-$X_2$-$X_3$-$X_4$-$X_5$-$Phe_6$-$Ser_7$-$Asp_8$-$(P_1)$-$X_{14}$-$Asp_{15}$-$X_{16}$-$X_{17}$-$Ala_{18}$-$X_{19}$-$X_{20}$-$X_{21}$-$Phe_{22}$-$(P_2)$-$Trp_{25}$-$Leu_{26}$-$X_{27}$-$X_{28}$-$Thr_{29}$-$Lys_{30}$-$P_3$-$(Y_2)_n$-$R_2$ (SEQ ID NOs: 2 and 29-252) wherein
   $X_1$ is His or Tyr;
   $X_2$ is Gly, D-Ala, Pro, Ile, Nor-Val, α-aminobutyric acid, or an Ala-replacement amino acid conferring on said analog resistance to DPP-IV enzyme;
   $X_3$ is Asp, Glu, Pro, HPro; or $X_2$-$X_3$ are $X_{2\psi}(CH(OH)CH_2)X_3$; $X_{2\psi}(CH_2NH_2)X_3$ or $X_{2\psi}(CHCH)X_3$ wherein $X_2$ and $X_3$ are as defined above;
   $X_4$ is Gly or Ala;
   $X_5$ is Ser or Ala;
   $P_1$ is Glu-$X_{10}$-Asn-Thr-Ile (SEQ ID NO: 253), Gly-$X_{10}$-Asn-Thr-Val (SEQ ID NO: 254) or Tyr-Ser-Lys-Tyr (SEQ ID NO: 255);
   $X_{10}$ is Met, Leu, Ile or an oxidatively stable Met-replacement amino acid;
   $X_{14}$ is Leu or Lys;
   $X_{16}$ is Asn, Lys or Ala;
   $X_{17}$ is Leu or Lys;
   $X_{19}$ is Ala or Thr;
   $X_{20}$ is Arg, Lys, His or Ala;
   $X_{21}$ is Asp or Lys;
   $X_{27}$ is Ile or Leu;
   $X_{28}$ is Gln or His;
   $P_2$ is Ile-Asn, Ile-Ala or Val-Gln;
   $P_3$ is a covalent bond, or is Ile, Ile-Thr, Ile-Thr-Asp or Ile-Thr-Asn;
   $R_1$ is $NH_2$ or a N-terminal blocking group;
   $R_2$ is COOH, $CONH_2$ or a C-terminal blocking group;
   $Y_1$ is one or two of Arg, Lys, and His;
   $Y_2$ is one or two of Arg, Lys, and His; and
   m and n are independently 0 or 1.

2. The gastrointestinal tissue growth promoter derivative of claim 1, wherein
   $X_1$ is His or Tyr;
   $X_2$ is Gly, D-Ala, Pro, or an Ala-replacement amino acid conferring on said analog resistance to DPP-JV enzyme;
   $X_3$ is Asp, Glu, Pro, or HPro;
   $X_4$ is Gly or Ala;
   $X_5$ is Ser or Ala;
   $P_1$ is Glu-$X_{10}$-Asn-Thr-Ile (SEQ ID NO: 253), Gly-$X_{10}$-Asn-Thr-Val (SEQ ID NO: 254) or Tyr-Ser-Lys-Tyr (SEQ ID NO: 255);
   $X_{10}$ is Met or an oxidatively stable Met-replacement amino acid;
   $X_{14}$ is Leu;
   $X_{16}$ is Asn, Lys or Ala;
   $X_{17}$ is Leu;
   $X_{19}$ is Ala or Thr;
   $X_{20}$ is Arg, Lys, His or Ala;
   $X_{21}$ is Asp;
   $X_{27}$ is Ile or Leu;
   $X_{28}$ is Gln or His;
   $P_2$ is Ile-Asn, Ile-Ala or Val-Gln;
   $P_3$ is a covalent bond, or is Ile, Ile-Thr, Ile-Thr-Asp or Ile-Thr-Asn;
   $R_1$ is $NH_2$;
   $R_2$ is a COOH, $CONH_2$ or a C-terminal blocking group;
   $Y_1$ is one or two of Arg, Lys, and His;
   $Y_2$ is one or two of Arg, Lys, and His; and
   m and n are independently 0 or 1.

3. The gastrointestinal growth promoter derivative of claim 1, wherein γ-maleimide-butyrylamide (GMBA), maleimidopropionic acid (MPA), (2-amino)ethoxy acetic acid (AEA)-MPA, ethylenediamine (EDA)-MPA, or 2-[2(2-amino)ethoxy]ethoxy acetic acid (AEEA)-MPA is coupled to the peptide.

4. The gastrointestinal tissue growth promoter derivative of claim 1, wherein (AEEA-EDA)-MPA, (AEEA-AEEA)-MPA, or (AEA-AEEA)-MPA is coupled to the peptide.

5. The gastrointestinal growth promoter derivative of claim 1, wherein the GLP-2 peptide is of the sequence:
   $R_1$-$His_1$-$Gly_2$-$Asp_3$-$Gly_4$-$Ser_5$-$Phe_6$-$Ser_7$-$Asp_8$-$Glu_9$-$Met_{10}$-$Asn_{11}$-$Thr_{12}$-$Ile_{13}$-$X_{14}$-$Asp_{15}$-$X_{16}$-$X_{17}$-$Ala_{18}$-$Ala_{19}$-$Arg_{20}$-$X_{21}$-$Phe_{22}$-$Ile_{23}$-$Asn_{24}$-$Trp_{25}Leu_{26}$-$Ile_{27}$-$Gln_{28}Thr_{29}Lys_{30}$-$Ile_{31}$-$Thr_{32}$-$Asp_{33}$-$(Y_2)_n$-$CONH_2$ (SEQ ID NOs: 256-258);
   wherein $X_{14}$ is Leu or Lys; $X_{16}$ is Asn or Lys; $X_{17}$ is Leu or Lys; $X_{21}$ is Asp or Lys;
   $R_1$ is $NH_2$ or a N-terminal blocking group;
   $Y_2$ is one or two of Arg, Lys, and His; and
   n is 0 or 1.

6. The gastrointestinal tissue growth promoter derivative of claim 5, wherein n is 1 and $Y_2$ is Lys.

7. The gastrointestinal growth promoter derivative of claim 5, wherein the gastrointestinal growth promoter derivative is MPA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-$CONH_2$ (SEQ ID NO: 8);

His-Gly-Asp-Gly-Ser-Phe-Ser-Asp-Glu-Met-Asn-Thr-Ile-Leu-Asp-Lys (MPA)-Leu-Ala-Ala-Arg-Asp-Phe-Ile-Asn-Trp-Leu-Ile-Gln-Thr-Lys-Ile-Thr-Asp-CONH$_2$ (SEQ ID NO: 9);

His-Gly-Asp-Gly-Ser-Phe-Ser-Asp-Glu-Met-Asn-Thr-Lle-Leu-Asp-Asn-Leu-Ala-Ala-Arg-Asp-Phe-Ile-Asn-Trp-Leu-lle-GLn-Thr-Lys-Ile-Thr-Asp-Lys(MPA)-CONH$_2$ (SEQ ID NO: 10);

His-Gly-Asp-Gly-Ser-Phe-Ser-Asp-Glu-Met-Asn-Thr-Ile-Leu-Asp-Lys (AEEA-MPA)-Leu-Ala-Ala-Arg-Asp-Phe-Ile-Asn-Trp-Leu-Ile-Gln-Thr-Lys-Ile-Thr-Asp-CONH$_2$ (SEQ ID NO: 11);

His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(AEEA-MPA)-CONH$_2$ (SEQ ID NO: 12); or

MPA-AEEA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 13).

8. The gastrointestinal growth promoter derivative of claim 5, wherein the gastrointestinal growth promoter derivative is
His-Gly-Asp-Gly-Ser-Phe-Ser-Asp-Glu-Met-Asn-Thr-Ile-Leu-Asp-Lys (MPA)-Leu-Ala-Ala-Arg-Asp-Phe-Ile-Asn-Trp-Leu-Ile-Gln-Thr-Lys-Ile-Thr-Asp-CONH$_2$ (SEQ ID NO: 9).

9. The gastrointestinal growth promoter derivative of claim 3, wherein the gastrointestinal growth promoter derivative is
His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(MPA)-CONH$_2$ (SEQ ID NO: 10).

10. The gastrointestinal growth promoter derivative of claim 5, wherein the gastrointestinal growth promoter derivative is
MPA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-CONH$_2$ (SEQ ID NO: 8).

11. A conjugate formed by covalently coupling a gastrointestinal tissue growth promoter derivative to a blood protein,
wherein the gastrointestinal tissue growth promoter derivative comprises:
a GLP-2 peptide having gastrointestinal tissue growth promoting activity;
a single maleimide or a maleimido-containing group, wherein the maleimide or maleimido-containing group is coupled, optionally via a linker, to the GLP-2 peptide at a His or Lys residue, and
wherein the GLP-2 peptide is of the sequence:
R$_1$ (Y$_1$)$_m$-X$_1$-X$_2$-X$_3$-X$_4$-X$_5$-Phe$_6$-Ser$_7$-Asp$_8$-(P$_1$)-X$_{14}$-Asp$_{15}$-X$_{16}$-X$_{17}$-Ala$_{18}$-X$_{19}$-X$_{20}$-X$_{21}$-Phe$_{22}$-(P$_2$)-Trp$_{25}$-Leu$_{26}$-X$_{27}$-X$_{28}$-Thr$_{29}$-Lys$_{30}$-P$_3$-(Y$_2$)$_n$-R$_2$
(SEQ ID NOs: 2 and 29-252) wherein
X$_1$ is His or Tyr;
X$_2$ is Gly, D-Ala, Pro, lle, Nor-Val, α-aminobutyric acid, or an Ala-replacement amino acid conferring on said analog resistance to DPP-IV enzyme;
X$_3$ is Asp, Glu, Pro, HPro; or X$_2$-X$_3$ are X$_2\psi$(CH(OH)CH$_2$)X$_3$;
X$_2\psi$(CH$_2$NH$_2$)X$_3$ or X$_2\psi$(CHCH)X$_3$ wherein X$_2$ and X$_3$ are as defined above;
X$_4$ is Gly or Ala;
X$_5$ is Ser or Ala;

P$_1$ is Glu-X$_{10}$-Asn-Thr-Ile (SEQ ID NO: 253) Gly-X$_{10}$-Asn-Thr-Val (SEQ ID NO: 254) or Tyr-Ser-Lys-Tyr (SEQ ID NO: 255);
X$_{10}$ is Met, Leu, Ile or an oxidatively stable Met-replacement amino acid;
X$_{14}$ is Leu or Lys;
X$_{16}$ is Asn, Lys or Ala;
X$_{17}$ is Leu or Lys;
X$_{19}$ is Ala or Thr;
X$_{20}$ is Arg, Lys, His or Ala;
X$_{21}$ is Asp or Lys;
X$_{27}$ is Ile or Leu;
X$_{28}$ is Gln or His;
P$_2$ is Ile-Asn, Ile-Ala or Val-Gln;
P$_3$ is a covalent bond, or is lle, Ile-Thr, Ile-Thr-Asp or Ile-Thr-Asn;
R$_1$ is NH$_2$ or a N-terminal blocking group;
R$_2$ is COOH, CONH$_2$ or a C-terminal blocking group;
Y$_1$ is one or two of Arg, Lys, and His;
Y$_2$ is one or two of Arg, Lys, and His; and
m and n are independently 0 or 1.

12. The conjugate of claim 11, wherein
X$_1$ is His or Tyr;
X$_2$ is Gly, D-Ala, Pro, or an Ala-replacement amino acid conferring on said analog resistance to DPP-IV enzyme;
X$_3$ is Asp, Glu, Pro, or HPro;
X$_4$ is Gly or Ala;
X$_5$ is Ser or Ala;
P$_1$ is Glu-X$_{10}$-Asn-Thr-Ile (SEQ ID NO: 253), Gly-X$_{10}$-Asn-Thr-Val (SEQ ID NO: 254) or Tyr-Ser-Lys-Tyr (SEQ ID NO: 255);
X$_{10}$ is Met or an oxidatively stable Met-replacement amino acid;
X$_{14}$ is Leu;
X$_{16}$ is Asn, Lys or Ala;
X$_{17}$ is Leu;
X$_{19}$ is Ala or Thr;
X$_{20}$ is Arg, Lys, His or Ala;
X$_{21}$ is Asp;
X$_{27}$ is Ile or Leu;
X$_{28}$ is Gln or His;
P$_2$ is Ile-Asn, Ile-Ala or Val-Gln;
P$_3$ is a covalent bond, or is Ile, Ile-Thr, Ile-Thr-Asp or Ile-Thr-Asn;
R$_1$ is NH$_2$;
R$_2$ is a COOH, CONH$_2$ or a C-terminal blocking group;
Y$_1$ is one or two of Arg, Lys, and His;
Y$_2$ is one or two of Arg, Lys, and His; and
m and n are independently 0 or 1.

13. The conjugate of claim 11, wherein the coupling of the gastrointestinal tissue growth promoter derivative is to a thiol group on the blood protein.

14. The conjugate of claim 11, 12, or 13 wherein the blood protein is albumin.

15. The conjugate of claim 11, wherein the GLP-2 peptide is of the sequence:
R$_1$-His$_1$-Gly$_2$-Asp$_3$-Gly$_4$-Ser$_5$-Phe$_6$-Ser$_7$-Asp$_8$-Glu$_9$-Met$_{10}$-Asn$_{11}$-Ile$_{13}$-X$_{14}$-Asp$_{15}$-X$_{16}$-X$_{17}$-Ala$_{18}$-Ala$_{19}$-Arg$_{20}$-X$_{21}$-Phe$_{22}$-Ile$_{23}$-Asn$_{24}$-Trp$_{25}$-Leu$_{26}$-Ile$_{27}$-Gln$_{28}$-Thr$_{29}$-Lys$_{30}$-Ile$_{31}$-Thr$_{32}$-Asp$_{33}$-(Y$_2$)$_n$-CONH$_2$ (SEQ ID NOs: 256-258);
wherein X$_{14}$ is Leu or Lys; X$_{16}$ is Asn or Lys; X$_{17}$ is Leu or Lys; X$_{21}$ is Asp or Lys;
R$_1$ is NH$_2$ or a N-terminal blocking group;
Y$_2$ is one or two of Arg, Lys, and His; and
n is 0 or 1.

16. The conjugate of claim 15, wherein n is 1 and $Y_2$ is Lys.

17. The conjugate of claim 15, wherein the blood protein is albumin.

18. The conjugate of claim 15, wherein the GLP-2 peptide is of the sequence:

MPA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-$CONH_2$ (SEQ ID NO: 8);

His-Gly-Asp-Gly-Ser-Phe-Ser-Asp-Glu-Met-Asn-Thr-Ile-Leu-Asp-Lys (MPA)-Leu-Ala-Ala-Arg-Asp-Phe-Ile-Asn-Trp-Leu-Ile-Gln-Thr-Lys-Ile-Thr-Asp-CONH2 (SEQ ID NO: 9);

His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(MPA)-$CONH_2$ (SEQ ID NO: 10);

His-Gly-Asp-Gly-Ser-Phe-Ser-Asp-Glu-Met-Asn-Thr-Ile-Leu-Asp-Lys (AEEA-MPA)-Leu-Ala-Ala-Arg-Asp-Phe-Ile-Asn-Trp-Leu-Ile-Gln-Thr-Lys-Ile-Thr-Asp-$CONH_2$ (SEQ ID NO: 11);

His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-Lys(AEEA-MPA)-$CONH_2$ (SEQ ID NO: 12); or

MPA-AEEA-His-Gly-Asp-Gly-Ser-Phe-Ser-Asp-Glu-Met-Asn-Thr-Ile-Leu-Asp-Asn-Leu-Ala-Ala-Arg-Asp-Phe-Ile-Asn-Trp-Leu-Ile-Gln-Thr-Lys-Ile-Thr-Asp-$CONH_2$ (SEQ ID NO: 13).

19. A composition comprising the conjugate of claim 11, 12, or 13; and a pharmaceutically acceptable carrier.

20. A composition comprising the conjugate of claim claim 11, 12, 13 wherein the blood protein is albumin and a pharmaceutically acceptable carrier.

21. A composition comprising the conjugate of claim 15; and a pharmaceutically acceptable carrier.

22. A composition comprising the conjugate of claim 17; and a pharmaceutically acceptable carrier.

23. A pharmaceutical composition comprising the gastrointestinal tissue growth promoter derivative of claim 1 or 2; and a pharmaceutically acceptable carrier.

24. A pharmaceutical composition comprising the gastrointestinal tissue growth promoter derivative of claim 5; and a pharmaceutically acceptable carrier.

25. A method for the treatment of a gastrointestinal disorder or disease in a subject comprising administering to a subject in need thereof an effective amount of the gastrointestinal growth promoter derivative of claim 1, wherein said gastrointestinal disorder or disease is inflammatory bowel disease, an ulcer or inflammatory disease of the small intestinal tract mucosa, small intestinal damage due to a toxic or a chemotherapeutic agent, or a disease or disorder caused by loss of small intestine mucosal function.

26. The method of claim 25, wherein the gastrointestinal disorder or disease is inflammatory bowel disease.

27. The method of claim 25 wherein said gastrointestinal disorder or disease is a disorder or disease caused by loss of small intestine mucosal function.

28. The method of claim 26, wherein the inflammatory bowel disease is ulcerative colitis.

29. The method of claim 26, wherein the inflammatory bowel disease is Crohn's disease.

30. The method of claim 27 wherein the subject is undergoing extended parenteral feeding.

31. The method of claim 27 wherein the subject has undergone resection of the small intestine.

32. The method of claim 31 wherein the subject has short bowel syndrome.

33. The method of claim 27 wherein the gastrointestinal disorder or disease is a malabsorption syndrome.

34. A method for the promotion of gastrointestinal tissue growth in a subject comprising administering to a subject in need thereof an effective amount of the gastrointestinal growth promoter derivative of claim 1.

35. A method for the treatment of a gastrointestinal disorder or disease treatable by increasing small intestinal mass and consequent small intestine mucosal function in a subject comprising administering to a subject in need thereof an effective amount of the gastrointestinal growth promoter derivative of claim 1.

36. A method for the determination of the intestinotrophic activity of a hormone comprising:
(a) coadministering the hormone with an intestinotrophic amount of a gastrointestinal growth promoter derivative of claim 1 to a test subject;
(b) assessing the subsequent growth of small and large intestine tissue in the test subject; and
(c) determining whether the growth of the small and/or Large intestine in the test subject is enhanced relative to control subjects treated with said gastrointestinal growth promoter derivative.

37. A method for the promotion of gastrointestinal tissue growth in a subject comprising administering to a subject in need thereof an effective amount of the conjugate of claim 11.

38. A method for the treatment of a gastrointestinal disorder or disease treatable by increasing small intestinal mass and consequent small intestine mucosal function in a subject comprising administering to a subject in need thereof an effective amount of the conjugate of claim 11.

39. A method for the treatment of a gastrointestinal disorder or disease in a subject comprising administering to a subject in need thereof an effective amount of the conjugate of claim 11, wherein said gastrointestinal disorder or disease is inflammatory bowel disease, an ulcer or inflammatory disease of the small intestinal tract mucosa, small intestinal damage due to a toxic or a chemotherapeutic agent, or a disease or disorder caused by loss of small intestine mucosal function.

40. The method of claim 39, wherein the gastrointestinal disorder or disease is inflammatory bowel disease.

41. The method of claim 39 wherein said gastrointestinal disorder or disease is a disorder or disease caused by loss of small intestine mucosal function.

42. The method of claim 40, wherein the inflammatory bowel disease is ulcerative colitis.

43. The method of claim 40, wherein the inflammatory bowel disease is Crohn's disease.

44. The method of claim 41 wherein the subject is undergoing extended parenteral feeding.

45. The method of claim 41 wherein the subject has undergone resection of the small intestine.

46. The method of claim 45 wherein the subject has short bowel syndrome.

47. The method of claim 41 wherein the gastrointestinal disorder or disease is a malabsorption syndrome.

48. The method of any one of claims 39-37 and 41-38 wherein the blood protein is albumin.

49. A method for the treatment of a gastrointestinal disorder or disease in a subject comprising administering to a subject in need thereof an effective amount of the conjugate of claim 18, wherein said gastrointestinal disorder or disease is inflammatory bowel disease, an ulcer or inflammatory disease of the small intestinal tract mucosa, small intestinal damage due to a toxic or a chemotherapeutic agent, or a disease or disorder caused by loss of small intestine mucosal function.

50. A method for the promotion of gastrointestinal tissue growth in a subject comprising administering to a subject in need thereof an effective amount of the conjugate of claim 18.

51. A method for the treatment of a gastrointestinal disorder or disease treatable by increasing small intestinal mass and consequent small intestine mucosal function in a subject comprising administering to a subject in need thereof an effective amount of the conjugate of claim 18.

52. A method for extending the in vivo half-life of a GLP-2 peptide comprising covalently bonding in vivo or ex vivo the GLP-2 peptide to a blood protein, wherein the GLP-2 peptide is of the sequence:

$R_1$-$(Y_1)_m$-$X_1$-$X_2$-$X_3$-$X_4$-$X_5$-$Phe_6$-$Ser_7$-$Asp_{18}$-$(P_1)$-$X_{14}$-$Asp_{15}$-$X_{16}$-$X_{17}$-$Ala_{18}$-$X_{19}$-$X_{20}$-$X_{21}$-$Phe_{22}$-$(P_2)$-$Trp_{25}$-$Leu_{26}$-$X_{27}$-$X_{28}$-$Thr_{29}$-$Lys_{30}$-$P_3$-$(Y_2)_n$-$R_2$ (SEQ ID NOs: 2 and 29-252) wherein $X_1$ is His or Tyr;

$X_2$ is Gly, D-Ala, Pro, Ile, Nor-Val, α-aminobutyric acid, or an Ala-replacement amino acid conferring on said analog resistance to DPP-IV enzyme;

$X_3$ is Asp, Glu, Pro, HPro; or $X_2$-$X_3$ are $X_{2\psi}(CH(OH)CH_2)X_3$; $X_{2\psi}(CH_2NH_2)X_3$ or $X_{2\psi}(CHCH)X_3$ wherein $X_2$ and $X_3$ are as defined above;

$X_4$ is Gly or Ala;

$X_5$ is Ser or Ala;

$P_1$ is Glu-X10-Asn-Thr-Ile (SEQ ID NO: 253), Gly-$X_{10}$-Asn-Thr-Val (SEQ ID NO: 254) or Tyr-Ser-Lys-Tyr (SEQ ID NO: 255);

$X_{10}$ is Met, Leu, Ile or an oxidatively stable Met-replacement amino acid;

$X_{14}$ is Leu or Lys;

$X_{16}$ is Asn, Lys or Ala;

$X_{17}$ is Leu or Lys;

$X_{19}$ is Ala or Thr;

$X_{20}$ is Arg, Lys, His or Ala;

$X_{21}$ is Asp or Lys;

$X_{27}$ is Ile or Leu;

$X_{28}$ is Gln or His;

$P_2$ is Ile-Asn, Ile-Ala or Val-Gln;

$P_3$ is a covalent bond, or is Ile, Ile-Thr, Ile-Thr-Asp or Ile-Thr-Asn;

$R_1$ is $NH_2$ or a N-terminal blocking group;

$R_2$ is COOH, $CONH_2$ or a C-terminal blocking group;

$Y_1$ is one or two of Arg, Lys, and His;

$Y_2$ is one or two of Arg, Lys, and His; and m and n are independently 0 or 1.

* * * * *